United States Patent
Kwong et al.

(10) Patent No.: US 12,053,519 B2
(45) Date of Patent: Aug. 6, 2024

(54) HIV-1 ENV FUSION PEPTIDE NANOPARTICLE CARRIER CONJUGATES AND THEIR USE

(71) Applicant:

(56) References Cited

OTHER PUBLICATIONS

Pichichero, "Protein Carriers of Conjugate Vaccines: Characteristics, Development, and Clinical Trials," *Human Vaccines & Immunotherapeutics* 9.12: 2505-2523, Dec. 2013.
Seaman et al., "Tiered Categorization of a Diverse Panel of HIV-1 Env Pseudoviruses for Assessment of Neutralizing Antibodies," *J Virol.* 84.3: 1439-1452, Feb. 2010.
Xu et al., "Epitope-Based Vaccine Design Yields Fusion Peptide-Directed Antibodies that Neutralize Diverse Strains of HIV-1," *Nat Med.* 24.6: 857-867, Jun. 2018.

Self-Assembling Protein Nanoparticle Carrier

FIG. 1B

Self-Assembling Protein Nanoparticle Carrier
conjugated to HIV-1 Env fusion peptides FP
Carrier protein
Protein nanoparticle Fusion Protein:
Carrier protein    Protein nanoparticle
                          subunit Self-Assembling Protein Nanoparticle Carrier
with T-Cell Helper epitopes

FIG. 1D

Self-Assembling Protein Nanoparticle Carrier
with T-Cell Helper epitopes
conjugated to HIV-1 Env fusion peptides

FIG. 1E

Self-Assembling Protein Nanoparticle Carrier
with T-Cell Helper epitopes
conjugated to HIV-1 Env fusion peptides

FIG. 1F

Self-Assembling Protein Nanoparticle Carrier
with T-Cell Helper epitopes
conjugated to HIV-1 Env fusion peptides

FIG. 1G

Self-Assembling Protein Nanoparticle Carrier
with targeting reagent and T-cell helper
epitope
conjugated to HIV-1 Env fusion peptides

FIG. 1H

Self-Assembling Protein Nanoparticle Carrier
with targeting reagent and T-cell helper epitope
conjugated to HIV-1 Env fusion peptides

FIG. 1I

Self-Assembling Protein Nanoparticle Carrier
with targeting reagent and T-cell helper epitope
conjugated to HIV-1 Env fusion peptides

- Targeting reagent
- FP
- Carrier protein
- Targeting reagent
- T-cell helper epitope
- Protein nanoparticle Fusion Protein: Carrier protein — Protein nanoparticle subunit — T-cell helper epitope — Targeting moiety Comparison of Trimer-specific immune response elicited by different FP-KLH

FIG. 3A 20aa linker used for the nanoparticle carrier

Signal peptide | Lumazine synthase | Linker | Tetanus Toxoid

LS-20-rTT mammalian cell expression construct

FIG. 3B

LS-20-rTT

λ (280nm) (mAU) vs Volume (mL)

FIG. 3C

LS-20-rTT

FIG. 4

IgG hinge as linker used for the nanoparticle carrier

LS-hinge2-rTT 2D classes

HiD-6CCQ-rTT

Nanoparticle linked to rTT Carrier by Isopeptide Bond

LS-SpyT/rTT-SpyC nanoparticle carrier

FIG. 8

Number of Conjugated FP on Nanoparticle Surface: ITC Analysis

FP-rTT monomer

LS-Spy-rTT-FP8v1/PEG2 nanoparticle carrier

- Each FP-rTT monomer entity has 6 competent VRC34 Fab binding sites

- Each LS-Spy-rTT-FP8v1/PEG2 nanoparticle carrier has 152 – 402 competent VRC34.01 Fab binding sites Disulfide bond stabilized nanoparticle carrier

DS Stabilized Encapsulin Nanoparticle Carrier Is Stable During FP8-Conjugation

EN-spyT rTT-spy-EN

FP8v1-rTT-spy-EN
SIAB

HIV-1 ENV FUSION PEPTIDE NANOPARTICLE CARRIER CONJUGATES AND THEIR USE

CROSS REFERENCE TO RELATED APPLICATIONS

This is the U.S. National Stage of International Application No. PCT/US2019/052419, filed Sep. 23, 2019, which was published in English under PCT Article 21(2), which in turn claims priority to U.S. Provisional Application No. 62/735,188, filed Sep. 23, 2018. The provisional application is incorporated by reference in its entirety.

FIELD

This disclosure relates to immunogenic conjugates including HIV-1 envelope (Env) fusion peptides conjugated to a self-assembling protein nanoparticle carrier and their use to induce an immune response in a subject.

BACKGROUND

Millions of people are infected with HIV-1 worldwide, and 2.5 to 3 million new infections have been estimated to occur yearly. Although effective antiretroviral therapies are available, millions succumb to AIDS every year, especially in sub-Saharan Africa, underscoring the need to develop measures to prevent the spread of this disease.

An enveloped virus, HIV-1 hides from humoral recognition behind a wide array of protective mechanisms. The major envelope protein of HIV-1 is a glycoprotein of approximately 160 kD (gp160). During infection, proteases of the host cell cleave gp160 into gp120 and gp41. Gp41 is an integral membrane protein, while gp120 protrudes from the mature virus. Together gp120 and gp41 make up the HIV-1 Env spike, which is a target for neutralizing antibodies.

It is believed that immunization with an effective immunogen including epitopes of the HIV-1 Env glycoprotein can elicit a neutralizing response, which may be protective against HIV-1 infection. However, despite extensive effort, a need remains for agents capable of such action.

SUMMARY

This disclosure provides novel immunogenic conjugates for eliciting an immune response to HIV-1 Env in a subject.

The immunogenic conjugates comprise a self-assembling protein-nanoparticle carrier conjugated to HIV-1 Env fusion peptides. The self-assembling protein-nanoparticle carrier is comprised of a multimer of fusion proteins. Each fusion protein in the multimer comprises a self-assembling protein nanoparticle subunit fused to a heterologous carrier protein. The fusion proteins self-assemble to form the self-assembling protein-nanoparticle carrier. The HIV-1 Env fusion peptides conjugated to the self-assembling protein-nanoparticle carrier, comprise, from the N-terminus, the amino acid sequence of residue 512 to one of residues 514-521 of a human immunodeficiency virus type 1 (HIV-1) Envelope (Env) protein (according to the HXB2 numbering system). In some embodiments, the fusion proteins in the self-assembling protein nanoparticle carrier further comprise a heterologous T-cell helper epitope. The immunogenic conjugate can be used elicit an immune response to HIV-1 Env in a subject.

Immunogenic compositions including a disclosed immunogenic conjugate are also provided. The composition may be a pharmaceutical composition suitable for administration to a subject, and may also be contained in a unit dosage form. The composition can further include an adjuvant.

Methods of generating an immune response to HIV-1 Env protein in a subject are disclosed, as are methods of treating, inhibiting or preventing an HIV-1 infection in a subject. In such methods a subject, such as a human subject, is administered an effective amount of a disclosed immunogenic conjugate to elicit the immune response. In several embodiments, the method comprises a prime-boost immunization protocol, where a disclosed immunogenic conjugate is used for the prime immunization. The subject can be, for example, a human subject at risk of or having an HIV-1 infection.

The foregoing and other features and advantages of this disclosure will become more apparent from the following detailed description of several embodiments which proceeds with reference to the accompanying figures.

BRIEF DESCRIPTION OF THE FIGURES

FIGS. 1A-1I depict embodiments of the self-assembling protein nanoparticle carrier disclosed herein conjugated (FIGS. 1C-1I) or not (FIGS. 1A and 1B) to HIV-1 Env fusion peptides. As shown in FIG. 1A, the self-assembling protein nanoparticle carrier is a multimer of fusion proteins, each including a self-assembling protein nanoparticle subunit fused to a heterologous carrier protein. In some embodiments, the fusion protein can further include a T-cell helper epitope (FIG. 1B), which is then included in the self-assembling protein nanoparticle carrier. The location of the T-cell-helper epitope can be varied in the fusion protein. FIGS. 1C-1I, the HIV-1 Env fusion peptides (FP) are conjugated to the self-assembling protein nanoparticle carrier. The HIV-1 Env fusion peptides can be conjugated to any suitable aspect of the self-assembling protein nanoparticle carrier. In some instances, sulfosuccinimidyl (4-iodoacetyl) aminobenzoate (Sulfo-SIAB) conjugation chemistry is used to conjugate the HIV-1 Env fusion peptides to exposed lysine residues of the self-assembling protein nanoparticle carrier. FIGS. 1G-1I illustrate additional embodiments that further include a targeting moiety that targets the immune system in a subject to enhance the immune response to the HIV-1 Env fusion peptide on the immunogenic conjugate. The depictions in FIGS. 1A-1I are for illustration purposes and are not drawn to scale and do not necessarily show the number or relative location of self-assembling protein nanoparticle subunits, carrier proteins, HIV-1 Env fusion peptides, and T-cell helper epitopes that are present in a disclosed immunogenic conjugate.

FIGS. 3A-3C shows a nanoparticle carrier assembly through genetic fusion of LS nanoparticle subunit and rTT carrier. FIG. 3A. Schematic of the fusion protein used to produce genetically fused rTT-LS nanoparticle. FIG. 3B. SEC profile of purified rTT-LS nanoparticle. FIG. 3C. Electron micrographs of genetically fused rTT-LS nanoparticle carrier shows particle species.

FIG. 4 shows electron micrographs of genetically fused rTT-LS nanoparticle carrier with a IgG hinge linking the rTT and LS subunit.

FIG. 6A. Schematic of the lumazine synthase-spytag and rTT-spycatcher fusion proteins used to produce isopeptide bond-fused rTT-LS nanoparticle. Subsequent to formation of the rTT-LS nanoparticle, HIV-1 fusion peptide (FP8) was conjugated to the nanoparticle-carrier by a PEG linker FIG. 6B. Coomassie stained SDS-PAGE shows the individual purified proteins. FIG. 6C. SEC profile of purified rTT-LS nanoparticle.

FIG. 8 shows results of isothermal calorimetry assays to determine the number of HIV-1 Env fusion peptides conjugated to monomeric rTT (FP-rTT) compared to the number of HIV-1 Env fusion peptides conjugated to the LS-SpyT nanoparticle joined to the rTT-SpyC fusion protein (LS-Spy-rTT-FP8v1/PEG2 nanoparticle carrier). The results show that each FP-rTT monomer entity has six competent VRC34 Fab binding sites, whereas each LS-Spy-rTT-FP8v1/PEG2 nanoparticle carrier has 152-402 competent VRC34.01 Fab binding sites.

FIG. 10A. Week 2 and Week 5 sera was assessed for FP binding by octet binding assay. FIG. 10B. Week, 2, 5, and 8 sera was assessed for BG505 trimer binding by ELISA. FIG. 10C. Week 17 sera was assessed for neutralization of BG505 virus with a mutation to remove glycan 611, as this viral variant is more sensitive to fusion peptide-directed antibodies (Kong et al. Science 352, 828-833, 2016).

SEQUENCE LISTING

Figure 1A:
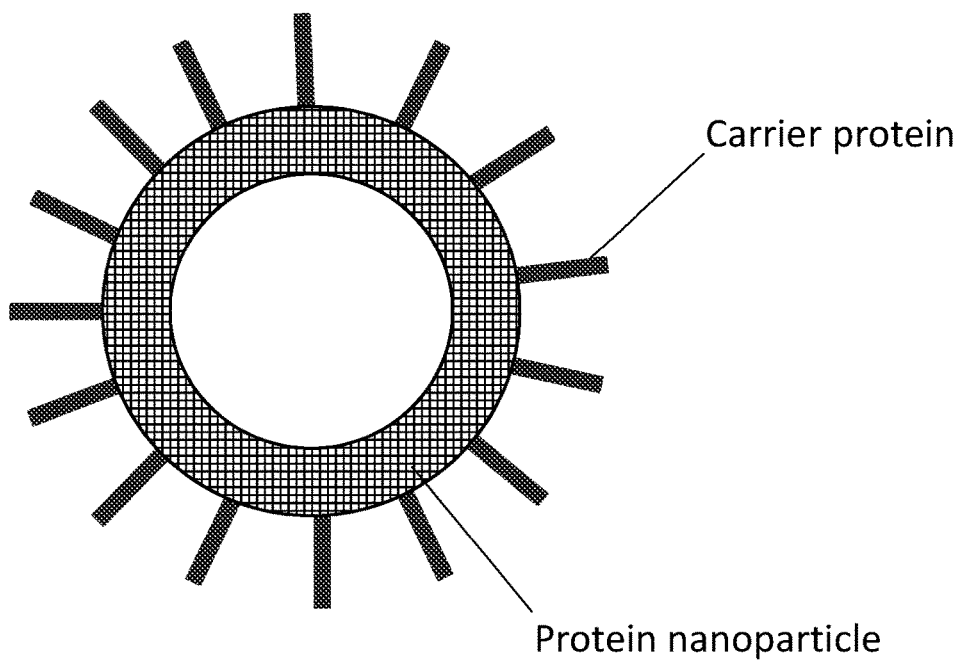

The nucleic and amino acid sequences listed in the accompanying sequence listing are shown using standard letter abbreviations for nucleotide bases, and three letter code for amino acids, as defined in 37 C.F.R. 1.822. Only one strand of each nucleic acid sequence is shown, but the complementary strand is understood as included by any reference to the displayed strand. The Sequence Listing is submitted as an ASCII text file in the form of the file named "Sequence.txt" (~1.5 MB), which was created on Mar. 11, 2021, which is incorporated by reference herein.

DETAILED DESCRIPTION

As the HIV-1 pandemic continues to infect millions of people each year, the need for an effective vaccine increases. However, the development of such a vaccine has been stymied due to the difficulty in developing an immunogen capable of eliciting broadly neutralizing antibodies. The current disclosure meets these needs.

One of the major hurdles to the construction of an effective HIV-1 vaccine is focusing the immune response to regions of HIV proteins which mostly produce broadly neutralizing antibodies. As disclosed herein, a series of immunogens that elicit immune responses to the HIV-1 Env fusion peptide has been constructed. Such molecules have utility as both potential vaccines for HIV and as diagnostic molecules (for example, to detect and quantify target antibodies in a polyclonal serum response).

I. SUMMARY OF TERMS

Unless otherwise noted, technical terms are used according to conventional usage. Definitions of common terms in molecular biology may be found in Benjamin Lewin, Genes X, published by Jones & Bartlett Publishers, 2009; and Meyers et al. (eds.), *The Encyclopedia of Cell Biology and Molecular Medicine*, published by Wiley-VCH in 16 volumes, 2008; and other similar references.

As used herein, the singular forms "a," "an," and "the," refer to both the singular as well as plural, unless the context clearly indicates otherwise. For example, the term "an antigen" includes single or plural antigens and can be considered equivalent to the phrase "at least one antigen." As used herein, the term "comprises" means "includes." It is further to be understood that any and all base sizes or amino acid sizes, and all molecular weight or molecular mass values, given for nucleic acids or polypeptides are approximate, and are provided for descriptive purposes, unless otherwise indicated. Although many methods and materials similar or equivalent to those described herein can be used, particular suitable methods and materials are described herein. In case of conflict, the present specification, including explanations of terms, will control. In addition, the materials, methods, and examples are illustrative only and not intended to be limiting. To facilitate review of the various embodiments, the following explanations of terms are provided:

Adjuvant: A vehicle used to enhance antigenicity. In some embodiments, an adjuvant can include a suspension of minerals (alum, aluminum hydroxide, or phosphate) on which antigen is adsorbed; or water-in-oil emulsion, for example, in which antigen solution is emulsified in mineral oil (Freund incomplete adjuvant), sometimes with the inclusion of killed mycobacteria (Freund's complete adjuvant) to further enhance antigenicity (inhibits degradation of antigen and/or causes influx of macrophages). In some embodiments, the adjuvant used in a disclosed immunogenic composition is a combination of lecithin and carbomer homopolymer (such as the ADJUPLEX™ adjuvant available from Advanced BioAdjuvants, LLC, see also Wegmann, Clin Vaccine Immunol, 22(9): 1004-1012, 2015). Additional adjuvants for use in the disclosed immunogenic compositions include the QS21 purified plant extract, Matrix M, AS01, MF59, and ALFQ adjuvants. Immunostimulatory oligonucleotides (such as those including a CpG motif) can also be used as adjuvants. Adjuvants include biological molecules (a "biological adjuvant"), such as costimulatory molecules. Exemplary adjuvants include IL-2, RANTES, GM-CSF, TNF-α, IFN-γ, G-CSF, LFA-3, CD72, B7-1, B7-2, OX-40L, 4-1BBL and toll-like receptor (TLR) agonists, such as TLR-9 agonists. Additional description of adjuvants can be found, for example, in Singh (ed.) Vaccine Adjuvants and Delivery Systems. Wiley-Interscience, 2007). Adjuvants can be used in combination with the disclosed immunogens.

Administration: The introduction of a composition into a subject by a chosen route. Administration can be local or systemic. For example, if the chosen route is intravenous, the composition (such as a composition including a disclosed immunogen) is administered by introducing the composition into a vein of the subject. Exemplary routes of administration include, but are not limited to, oral, injection (such as subcutaneous, intramuscular, intradermal, intraperitoneal, and intravenous), sublingual, rectal, transdermal (for example, topical), intranasal, vaginal, and inhalation routes.

Amino acid substitution: The replacement of an amino acid in a polypeptide with one or more different amino acids.

Antigen: A compound, composition, or substance that can stimulate the production of antibodies or a T cell response in an animal, including compositions that are injected or absorbed into an animal. An antigen reacts with the products of specific humoral or cellular immunity, including those induced by heterologous antigens, such as the disclosed HIV antigens. Examples of antigens include, but are not limited to, polypeptides, peptides, lipids, polysaccharides, combinations thereof (such as glycopeptides) and nucleic acids containing antigenic determinants, such as those recognized by an immune cell. A vaccine antigen is an antigen that, when administered to a subject, elicits a prophylactic or therapeutic immune response in the subject.

Carrier protein: An immunogenic protein to which an antigen can be linked. When linked to a carrier, the antigen may become more immunogenic. Carriers are chosen to increase the immunogenicity of the antigen and/or to elicit antibodies against the carrier which are diagnostically, analytically, and/or therapeutically beneficial. Useful carrier proteins include polymeric carriers, which can be natural (for example, proteins from bacteria or viruses), semi-synthetic or synthetic materials containing one or more functional groups to which a reactant moiety can be attached.

Conjugated: A first moiety joined to a second moiety by a covalent bond. For example, a peptide (such as an HIV-1 Env fusion peptide) joined to a carrier (such as a self-assembling protein nanoparticle carrier as described herein) by a chemical linker (such as a Sulfo-SIAB linker).

Conservative variant: "Conservative" amino acid substitutions are those substitutions or deletions that do not substantially affect or decrease a function of a protein, such as the ability of the protein to elicit an immune response when administered to a subject. The term conservative amino acid substitution also includes the use of a substituted amino acid in place of an unsubstituted parent amino acid. Furthermore, individual substitutions, deletions or additions which alter, add or delete a single amino acid or a small percentage of amino acids (for instance less than 5%, in some embodiments less than 1%) in an encoded sequence are conservative variations where the alterations result in the substitution of an amino acid with a chemically similar amino acid.

The following six groups are examples of amino acids that are considered to be conservative substitutions for one another:
1) Alanine (A), Serine (S), Threonine (T);
2) Aspartic acid (D), Glutamic acid (E);
3) Asparagine (N), Glutamine (Q);
4) Arginine (R), Lysine (K);
5) Isoleucine (I), Leucine (L), Methionine (M), Valine (V); and
6) Phenylalanine (F), Tyrosine (Y), Tryptophan (W).

Non-conservative substitutions are those that reduce an activity or function of the recombinant Env protein, such as the ability to elicit an immune response when administered to a subject. For instance, if an amino acid residue is essential for a function of the protein, even an otherwise conservative substitution may disrupt that activity. Thus, a conservative substitution does not alter the basic function of a protein of interest.

Consists essentially of and Consists Of: A polypeptide comprising an amino acid sequence that consists essentially of a specified amino acid sequence does not include any additional amino acid residues. However, the residues in the polypeptide can be modified to include non-peptide components, such as labels (for example, fluorescent, radioactive, or solid particle labels), sugars or lipids, and the N- or C-terminus of the polypeptide can be joined (for example, by peptide bond) to heterologous amino acids, such as a cysteine (or other) residue in the context of a linker for conjugation chemistry. A polypeptide that consists of a specified amino acid sequence does not include any additional amino acid residues, nor does it include additional biological components, such as nucleic acids lipids, sugars, nor does it include labels. However, the N- or C-terminus of the polypeptide can be joined (for example, by peptide bond) to heterologous amino acids, such as a peptide tag, or a cysteine (or other) residue in the context of a linker for conjugation chemistry.

A polypeptide that consists or consists essentially of a specified amino acid sequence can be glycosylated or have an amide modification. A polypeptide that consists of or consists essentially of a particular amino acid sequence can be linked via its N- or C-terminus to a heterologous polypeptide, such as in the case of a fusion protein containing a first polypeptide consisting or a first sequence that is linked (via peptide bond) to a heterologous polypeptide consisting of a second sequence. In another example, the N- or C-terminus of a polypeptide that consists of or consists essentially of a particular amino acid sequence can be linked to a peptide linker (via peptide bond) that is further linked to one or more additional heterologous polypeptides. In a further example, the N- or C-terminus of a polypeptide that consists of or consists essentially of a particular amino acid sequence can be linked to one or more amino acid residues that facilitate further modification or manipulation of the polypeptide.

Control: A reference standard. In some embodiments, the control is a negative control sample obtained from a healthy patient. In other embodiments, the control is a positive control sample obtained from a patient diagnosed with HIV-1 infection. In still other embodiments, the control is a historical control or standard reference value or range of values (such as a previously tested control sample, such as a group of HIV-1 patients with known prognosis or outcome, or group of samples that represent baseline or normal values).

A difference between a test sample and a control can be an increase or conversely a decrease. The difference can be a qualitative difference or a quantitative difference, for example, a statistically significant difference. In some examples, a difference is an increase or decrease, relative to a control, of at least about 5%, such as at least about 10%, at least about 20%, at least about 30%, at least about 40%, at least about 50%, at least about 60%, at least about 70%, at least about 80%, at least about 90%, at least about 100%, at least about 150%, at least about 200%, at least about 250%, at least about 300%, at least about 350%, at least about 400%, at least about 500%, or greater than 500%.

Covalent bond: An interatomic bond between two atoms, characterized by the sharing of one or more pairs of electrons by the atoms. The terms "covalently bound" or "covalently linked" refer to making two separate molecules into one contiguous molecule. The terms include reference to conjugating an antigen (such as an HIV-1 Env fusion peptide) either directly or indirectly to a carrier molecule, for example indirectly with an intervening linker molecule.

Effective amount: An amount of agent, such as an immunogen, that is sufficient to generate a desired response, such as an immune response in a subject. It is understood that to obtain a protective immune response against an antigen of interest can require multiple administrations of a disclosed immunogen, and/or administration of a disclosed immunogen as the "prime" in a prime boost protocol wherein the boost immunogen can be different from the prime immunogen. Accordingly, an effective amount of a disclosed immunogen can be the amount of the immunogen sufficient to elicit a priming immune response in a subject that can be subsequently boosted with the same or a different immunogen to generate a protective immune response.

In one example, a desired response is to induce an immune response that inhibits or prevents HIV-1 infection. The HIV-1 infected cells do not need to be completely eliminated or prevented for the composition to be effective. For example, administration of an effective amount of the immunogen can induce an immune response that decreases the number of HIV-1 infected cells (or prevents the infection of cells) by a desired amount, for example, by at least 50%, at least 60%, at least 70%, at least 80%, at least 90%, at least 95%, at least 98%, or even at least 100% (elimination or prevention of detectable HIV-1 infected cells), as compared to the number of HIV-1 infected cells in the absence of the immunization.

Expression: Transcription or translation of a nucleic acid sequence. For example, a gene is expressed when its DNA is transcribed into an RNA or RNA fragment, which in some examples is processed to become mRNA. A gene may also be expressed when its mRNA is translated into an amino acid sequence, such as a protein or a protein fragment. In a particular example, a heterologous gene is expressed when it is transcribed into an RNA. In another example, a heterologous gene is expressed when its RNA is translated into an amino acid sequence. The term "expression" is used herein to denote either transcription or translation. Regulation of expression can include controls on transcription, translation, RNA transport and processing, degradation of intermediary molecules such as mRNA, or through activation, inactivation, compartmentalization or degradation of specific protein molecules after they are produced.

Expression Control Sequences: Nucleic acid sequences that regulate the expression of a heterologous nucleic acid sequence to which it is operatively linked Expression control sequences are operatively linked to a nucleic acid sequence when the expression control sequences control and regulate the transcription and, as appropriate, translation of the nucleic acid sequence. Thus expression control sequences can include appropriate promoters, enhancers, transcription terminators, a start codon (ATG) in front of a protein-encoding gene, splicing signal for introns, maintenance of the correct reading frame of that gene to permit proper translation of mRNA, and stop codons. The term "control sequences" is intended to include, at a minimum, components whose presence can influence expression, and can also include additional components whose presence is advantageous, for example, leader sequences and fusion partner sequences. Expression control sequences can include a promoter.

A promoter is a minimal sequence sufficient to direct transcription. Also included are those promoter elements which are sufficient to render promoter-dependent gene expression controllable for cell-type specific, tissue-specific, or inducible by external signals or agents; such elements may be located in the 5' or 3' regions of the gene. Both constitutive and inducible promoters are included (see for example, Bitter et al., *Methods in Enzymology* 153:516-544, 1987). For example, when cloning in bacterial systems, inducible promoters such as pL of bacteriophage lambda, plac, ptrp, ptac (ptrp-lac hybrid promoter) and the like may be used. In one embodiment, when cloning in mammalian cell systems, promoters derived from the genome of mammalian cells (such as metallothionein promoter) or from mammalian viruses (such as the retrovirus long terminal repeat; the adenovirus late promoter; the vaccinia virus 7.5K promoter) can be used. Promoters produced by recombinant DNA or synthetic techniques may also be used to provide for transcription of the nucleic acid sequences.

Fusion protein: A single polypeptide chain including the sequence of two or more heterologous proteins, often linked by a peptide linker. Reference to a first protein "fused" to a second protein indicates that the first and second proteins are contained within a single contiguous polypeptide chain. The first and second protein may be directly linked (for example, the C-terminus of the first protein is linked to the N-terminus of the second protein by a peptide bond), or indirectly linked (for example, the C-terminus of the first protein is directly linked to the N-terminus of a peptide linker by a peptide bond, and the C-terminus of the peptide linker is directly linked to the N-terminus of the second protein by a peptide bond).

Heterologous: Originating from a different genetic source.

Host cells: Cells in which a vector can be propagated and its DNA expressed. The cell may be prokaryotic or eukaryotic. The term also includes any progeny of the subject host cell. It is understood that all progeny may not be identical to the parental cell since there may be mutations that occur during replication. However, such progeny are included when the term "host cell" is used.

Human Immunodeficiency Virus Type 1 (HIV-1): A retrovirus that causes immunosuppression in humans (HIV-1 disease), and leads to a disease complex known as the acquired immunodeficiency syndrome (AIDS). "HIV-1 disease" refers to a well-recognized constellation of signs and symptoms (including the development of opportunistic infections) in persons who are infected by an HIV-1 virus, as determined by antibody or western blot studies. Laboratory findings associated with this disease include a progressive decline in T cells. Related viruses that are used as animal models include simian immunodeficiency virus (SIV), and feline immunodeficiency virus (FIV). Treatment of HIV-1 with HAART has been effective in reducing the viral burden and ameliorating the effects of HIV-1 infection in infected individuals.

HIV-1 envelope protein (Env): The HIV-1 Env protein is initially synthesized as a precursor protein of 845-870 amino acids in size. Individual precursor polypeptides form a homotrimer and undergo glycosylation within the Golgi apparatus as well as processing to remove the signal peptide, and cleavage by a cellular protease between approximately positions 511/512 to generate separate gp120 and gp41 polypeptide chains, which remain associated as gp120-gp41 protomers within the homotrimer. The ectodomain (that is, the extracellular portion) of the HIV-1 Env trimer undergoes several structural rearrangements from a prefusion mature (cleaved) closed conformation that evades antibody recognition, through intermediate conformations that bind to receptors CD4 and co-receptor (either CCR5 or CXCR4), to a postfusion conformation. The HIV-1 Env ectodomain comprises the gp120 protein (approximately HIV-1 Env positions 31-511) and the gp41 ectodomain (approximately HIV-1 Env positions 512-644). An HIV-1 Env ectodomain trimer comprises a protein complex of three HIV-1 Env ectodomains. As used herein "HIV-1 Env ectodomain trimer" includes both soluble trimers (that is, trimers without gp41 transmembrane domain or cytoplasmic tail) and membrane anchored trimers (for example, trimers including a full-length gp41).

Mature gp120 includes approximately HIV-1 Env residues 31-511, contains most of the external, surface-exposed, domains of the HIV-1 Env trimer, and it is gp120 which binds both to cellular CD4 receptors and to cellular chemokine receptors (such as CCR5). A mature gp120 polypeptide is an extracellular polypeptide that interacts with the gp41 ectodomain to form an HIV-1 Env protomer that trimerizes to form the HIV-1 Env ectodomain trimer. The mature gp120 wild-type polypeptide is heavily N-glycosylated, giving rise to an apparent molecular weight of 120 kD. Native gp120 includes five conserved regions (C1-05) and five regions of high variability (V1-V5).

Mature gp41 includes approximately HIV-1 Env residues 512-860, and includes cytosolic-, transmembrane-, and ecto-domains. The gp41 ectodomain (including approximately HIV-1 Env residues 512-644) can interact with gp120 to form an HIV-1 Env protomer that trimerizes to form the HIV-1 Env trimer. The HIV-1 Env fusion peptide is located at the N-terminus of gp41. Prior use of the HIV-1 Env fusion peptide for immunization (e.g., as described in Dingens et al, Plos Pathog., 14(7), e1007159, 2018; and Xu et al., Nat. Med., 24(6):857-867, 2018, each of which is incorporated by reference herein) illustrated HIV-1 Env fusion peptide-based immunization protocols.

The prefusion mature closed conformation of the HIV-1 Env ectodomain trimer is a structural conformation adopted by HIV-1 Env ectodomain trimer after cellular processing to a mature prefusion state with distinct gp120 and gp41 polypeptide chains, and before specific binding to the CD4 receptor. The three-dimensional structure of an exemplary HIV-1 Env ectodomain trimer in the prefusion mature closed conformation is known (see, e.g., Pancera et al., Nature, 514:455-461, 2014). In the prefusion mature closed conformation, the HIV-1 Env ectodomain trimer includes a V1V2 domain "cap" at its membrane distal apex, with the V1V2 domain of each Env protomer in the trimer coming together at the membrane distal apex. At the membrane proximal aspect, the prefusion mature closed conformation of the HIV-1 Env ectodomain trimer includes distinct α6 and α7 helices. CD4 binding causes changes in the conformation of the HIV-1 Env ectodomain trimer, including disruption of the V1V1 domain cap, which "opens" as each V1V2 domain moves outward from the longitudinal axis of the Env trimer, and formation of the HR1 helix, which includes both the α6 and α7 helices (which are no longer distinct). These conformational changes bring the N-terminus of the fusion peptide within close proximity of the target cell membrane, and expose "CD4-induced" epitopes (such as the 17b epitope) that are present in the CD4-bound open conformation, but not the mature closed conformation, of the HIV-1 Env ectodomain trimer.

Unless context indicates otherwise, the numbering used in the disclosed HIV-1 Env proteins and fragments thereof (such as a gp120 and gp41) is relative to the HXB2 numbering scheme as set forth in *Numbering Positions in HIV Relative* to HXB2CG Bette Korber et al., Human Retroviruses and AIDS 1998: A Compilation and Analysis of Nucleic Acid and Amino Acid Sequences. Korber et al., Eds. Theoretical Biology and Biophysics Group, Los Alamos National Laboratory, Los Alamos, NM, which is incorporated by reference herein in its entirety. For reference, the amino acid sequence of HIV-1 Env of HXB2 is set forth as SEQ ID NO: 154 (GENBANK® GI:1906382, incorporated by reference herein as present in the database on Jun. 20, 2014).

HXB2 (Clade B, SEQ ID NO: 13):
MRVKEKYQHLWRWGWRWGTMLLGMLMICSATEKLWVTVYYGVPVWKEATTT

LFCASDAKAYDTEVHNVWATHACVPTDPNPQEVVLVNVTENFNMWKNDMVE

QMHEDIISLWDQSLKPCVKLTPLCVSLKCTDLKNDTNTNSSSGRMIMEKGE

IKNCSFNISTSIRGKVQKEYAFFYKLDIIPIDNDTTSYKLTSCNTSVITQA

CPKVSFEPIPIHYCAPAGFAILKCNNKTFNGTGPCTNVSTVQCTHGIRPVV

STQLLLNGSLAEEEVVIRSVNFTDNAKTIIVQLNTSVEINCTRPNNNTRKR

IRIQRGPGRAFVTIGKIGNMRQAHCNISRAKWNNTLKQIASKLREQFGNNK

TIIFKQSSGGDPEIVTHSFNCGGEFFYCNSTQLFNSTWFNSTWSTEGSNNT

EGSDTITLPCRIKQIINMWQKVGKAMYAPPISGQIRCSSNITGLLLTRDGG

NSNNESEIFRPGGGDMRDNWRSELYKYKVVKIEPLGVAPTKAKRRVVQREK

RAVGIGALFLGFLGAAGSTMGAASMTLTVQARQLLSGIVQQQNNLLRAIEA

QQHLLQLTVWGIKQLQARILAVERYLKDQQLLGIWGCSGKLICTTAVPWNA

SWSNKSLEQIWNHTTWMEWDREINNYTSLIHSLIEESQNQQEKNEQELLEL

DKWASLWNWFNITNWLWYIKLFIMIVGGLVGLRIVFAVLSIVNRVRQGYSP

LSFQTHLPTPRGPDRPEGIEEEGGERDRDRSIRLVNGSLALIWDDLRSLCL

```
-continued
FSYHRLRDLLLIVTRIVELLGRRGWEALKYWWNLLQYWSQELKNSAVSLLN

ATAIAVAEGTDRVIEVVQGACRAIRHIPRRIRQGLERILL
```

HIV-1 neutralizing antibody: An antibody that reduces the infectious titer of HIV-1 by binding to HIV-1 Env protein and inhibiting HIV-1 function. In some embodiments, neutralizing antibodies to HIV-1 can inhibit the infectivity of multiple strains of HIV-1, Teir-2 strain from multiple clades of HIV-1. In some embodiments, a disclosed immunogen can be administered to a subject to elicit an immune response that includes production of antibodies that specifically bind to the HIV-1 Env fusion peptide and neutralize Teir-2 strains of HIV-1 from multiple HIV-1 clades.

Immune response: A response of a cell of the immune system, such as a B cell, T cell, or monocyte, to a stimulus. In one embodiment, the response is specific for a particular antigen (an "antigen-specific response"). In one embodiment, an immune response is a T cell response, such as a CD4+ response or a CD8+ response. In another embodiment, the response is a B cell response, and results in the production of specific antibodies. "Priming an immune response" refers to treatment of a subject with a "prime" immunogen to induce an immune response that is subsequently "boosted" with a boost immunogen. Together, the prime and boost immunizations produce the desired immune response in the subject. "Enhancing an immune response" refers to co-administration of an adjuvant and an immunogenic agent, wherein the adjuvant increases the desired immune response to the immunogenic agent compared to administration of the immunogenic agent to the subject in the absence of the adjuvant.

Immunogen: A protein or a portion thereof that is capable of inducing an immune response in a mammal, such as a mammal infected or at risk of infection with a pathogen.

Immunogenic composition: A composition comprising a disclosed immunogen that elicits a measurable CTL response against the immunogen, or elicits a measurable B cell response (such as production of antibodies) against the immunogen, when administered to a subject. For in vivo use, the immunogenic composition will typically include the immunogen in a pharmaceutically acceptable carrier and may also include other agents, such as an adjuvant.

Immunogenic conjugate: A composition including of at least two heterologous molecules (such as an HIV-1 Env fusion peptide and a carrier, such as a self-assembling protein nanoparticle carrier) conjugated together. In a non-limiting example, a peptide (such as AVGIGAVF peptide, residues 1-8 of SEQ ID NO: 1) is linked to a protein carrier by a linker including a heterologous cysteine residue fused to the C-terminal residue of the peptide by peptide bond and a heterobifunctional moiety, wherein the heterobifunctional moiety is linked to a lysine residue on the carrier and the cysteine residue. In this example, the peptide is indirectly covalently linked to the carrier by the linker Immunogenic conjugates are conjugates that are useful for eliciting a specific immune response to a molecule in the conjugate in a vertebrate. In some embodiments where the conjugate includes a viral antigen, the immune response is protective in that it enables the vertebrate animal to better resist infection from the virus from which the antigen is derived.

Inhibiting or treating a disease: Inhibiting the full development of a disease or condition, for example, in a subject who is at risk for a disease such as acquired immunodeficiency syndrome (AIDS). "Treatment" refers to a therapeutic intervention that ameliorates a sign or symptom of a disease or pathological condition after it has begun to develop. The term "ameliorating," with reference to a disease or pathological condition, refers to any observable beneficial effect of the treatment. Inhibiting a disease can include preventing or reducing the risk of the disease, such as preventing or reducing the risk of viral infection. The beneficial effect can be evidenced, for example, by a delayed onset of clinical symptoms of the disease in a susceptible subject, a reduction in severity of some or all clinical symptoms of the disease, a slower progression of the disease, a reduction in the viral load, an improvement in the overall health or well-being of the subject, or by other parameters that are specific to the particular disease. A "prophylactic" treatment is a treatment administered to a subject who does not exhibit signs of a disease or exhibits only early signs for the purpose of decreasing the risk of developing pathology.

Isolated: An "isolated" biological component has been substantially separated or purified away from other biological components, such as other biological components in which the component naturally occurs, such as other chromosomal and extrachromosomal DNA, RNA, and proteins. Proteins, peptides, nucleic acids, and viruses that have been "isolated" include those purified by standard purification methods. Isolated does not require absolute purity, and can include protein, peptide, nucleic acid, or virus molecules that are at least 50% isolated, such as at least 75%, 80%, 90%, 95%, 98%, 99%, or even 99.9% isolated.

Linked: The term "linked" means joined together, either directly or indirectly. For example, a first moiety may be covalently or noncovalently (e.g., electrostatically) linked to a second moiety. This includes, but is not limited to, covalently bonding one molecule to another molecule, noncovalently bonding one molecule to another (e.g. electrostatically bonding), non-covalently bonding one molecule to another molecule by hydrogen bonding, non-covalently bonding one molecule to another molecule by van der Waals forces, and any and all combinations of such couplings. Indirect attachment is possible, such as by using a "linker". In several embodiments, linked components are associated in a chemical or physical manner so that the components are not freely dispersible from one another, at least until contacting a cell, such as an immune cell.

Linker: One or more molecules or groups of atoms positioned between two moieties. Typically, linkers are bifunctional, i.e., the linker includes a functional group at each end, wherein the functional groups are used to couple the linker to the two moieties. The two functional groups may be the same, i.e., a homobifunctional linker, or different, i.e., a heterobifunctional linker. In several embodiments, a peptide linker can be used to link the C-terminus of a first protein to the N-terminus of a second protein. Non-limiting examples of peptide linkers include glycine-serine peptide linkers, which are typically not more than 10 amino acids in length. In a non-limiting example, a peptide (such as AVGIGAVF peptide, residues 1-8 of SEQ ID NO: 1) is linked to a protein carrier by a linker including a heterologous cysteine residue fused to the C-terminal residue of the peptide by peptide bond and a heterobifunctional moiety, wherein the heterobifunctional moiety is linked to a lysine residue on the carrier and the cysteine residue.

Nucleic acid molecule: A polymeric form of nucleotides, which may include both sense and anti-sense strands of RNA, cDNA, genomic DNA, and synthetic forms and mixed polymers of the above. A nucleotide refers to a ribonucleotide, deoxynucleotide or a modified form of either type of nucleotide. The term "nucleic acid molecule" as used herein is synonymous with "nucleic acid" and "polynucleotide." A nucleic acid molecule is usually at least 10 bases in length, unless otherwise specified. The term includes single- and double-stranded forms of DNA. A polynucleotide may include either or both naturally occurring and modified nucleotides linked together by naturally occurring and/or non-naturally occurring nucleotide linkages. "cDNA" refers to a DNA that is complementary or identical to an mRNA, in either single stranded or double stranded form. "Encoding" refers to the inherent property of specific sequences of nucleotides in a polynucleotide, such as a gene, a cDNA, or an mRNA, to serve as templates for synthesis of other polymers and macromolecules in biological processes having either a defined sequence of nucleotides (i.e., rRNA, tRNA and mRNA) or a defined sequence of amino acids and the biological properties resulting therefrom.

Pattern recognition receptor: A protein receptor expressed by cells of the immune system to identify pathogen-associated molecular patterns (PAMPS) as well as damage associated molecular patterns (DAMPs). PAMP or DAMP activation of pattern recognition receptors induces an intracellular signaling cascade resulting in the alteration of the host cell's transcription profile to induce expression of pro-inflammatory and pro-survival genes that enhance adaptive immunity Non-limiting examples of pattern recognition receptors (PRRs) include Toll-like receptors (TLR), Stimulator of Interferon Genes receptor (STING), C-type lectin receptors (CLR), RIG-I-like receptors (RLR), and NOD-like receptors (NLR). In some embodiments, agonists of such pattern recognition receptors can be linked to a disclosed immunogenic conjugate to target the conjugate to pattern recognition receptor expressing cells (i.e., cells of the immune system) to enhance the immune response to the immunogenic conjugate.

Toll-like receptors (TLRs) 1-13 are transmembrane PRRs that recognize a diverse range of PAMPs. TLRs can be divided into two broad categories—those that are localized to the cell surface and those that are localized to the endosomal lumen. TLRs that are present on the cell surface are important in recognition of bacterial pathogens. TLRs that are localized to the lumen of endosomes, such as TLRs 3, 7, 8, and 9, serve to recognize nucleic acids and are thus thought to be important in the promotion of antiviral immune responses. TLR-7 and TLR-8 recognize ssRNA. Several different imidazoquinoline compounds are known TLR-7/8 agonists. TLR-9 recognizes unmethylated deoxycytidylate-phosphate-deoxyguanylate (CpG) DNA, found primarily in bacteria.

The NOD-like receptors (NLRs) and the RIG-I-like receptors (RLRs) are localized to the cytoplasm. Non-limiting examples of RLRs include RIG-I, MDA5, and LGP2. There are 22 human NLRs that can be subdivided into the five structurally related NLR families A, B, C, P, and X. All NLRs have three domains: an N-terminal domain involved in signaling, a nucleotide-binding NOD domain, and a C-terminal leucine rich region (LRR) important for ligand recognition. Non-limiting examples of NLRs include NALP3 and NOD2.

For more information on pattern recognition receptors, see Wales et al., Biochem Soc Trans., 35:1501-1503, 2007.

Pharmaceutically acceptable carriers: The pharmaceutically acceptable carriers of use are conventional. Remington's Pharmaceutical Sciences, by E. W. Martin, Mack Publishing Co., Easton, PA, 19th Edition, 1995, describes compositions and formulations suitable for pharmaceutical delivery of the disclosed immunogens.

In general, the nature of the carrier will depend on the particular mode of administration being employed. For instance, parenteral formulations usually comprise injectable fluids that include pharmaceutically and physiologically acceptable fluids such as water, physiological saline, balanced salt solutions, aqueous dextrose, glycerol or the like as a vehicle. For solid compositions (e.g., powder, pill, tablet, or capsule forms), conventional non-toxic solid carriers can include, for example, pharmaceutical grades of mannitol, lactose, starch, or magnesium stearate. In addition to biologically neutral carriers, pharmaceutical compositions to be administered can contain minor amounts of non-toxic auxiliary substances, such as wetting or emulsifying agents, preservatives, and pH buffering agents and the like, for example, sodium acetate or sorbitan monolaurate. In particular embodiments, suitable for administration to a subject the carrier may be sterile, and/or suspended or otherwise contained in a unit dosage form containing one or more measured doses of the composition suitable to elicit the desired anti-HIV-1 immune response. It may also be accompanied by medications for its use for treatment purposes. The unit dosage form may be, for example, in a sealed vial that contains sterile contents or a syringe for injection into a subject, or lyophilized for subsequent solubilization and administration or in a solid or controlled release dosage.

Polypeptide: Any chain of amino acids, regardless of length or post-translational modification (e.g., glycosylation or phosphorylation). "Polypeptide" applies to amino acid polymers including naturally occurring amino acid polymers and non-naturally occurring amino acid polymer as well as in which one or more amino acid residue is a non-natural amino acid, for example, an artificial chemical mimetic of a corresponding naturally occurring amino acid. A "residue" refers to an amino acid or amino acid mimetic incorporated in a polypeptide by an amide bond or amide bond mimetic. A polypeptide has an amino terminal (N-terminal) end and a carboxy terminal (C-terminal) end. "Polypeptide" is used interchangeably with peptide or protein, and is used herein to refer to a polymer of amino acid residues.

Prime-boost immunization: An immunotherapy including administration of multiple immunogens over a period of time to elicit the desired immune response.

Recombinant: A recombinant nucleic acid molecule is one that has a sequence that is not naturally occurring, for example, includes one or more nucleic acid substitutions, deletions or insertions, and/or has a sequence that is made by an artificial combination of two otherwise separated segments of sequence. This artificial combination can be accomplished by chemical synthesis or, more commonly, by the artificial manipulation of isolated segments of nucleic acids, for example, by genetic engineering techniques.

A recombinant virus is one that includes a genome that includes a recombinant nucleic acid molecule.

A recombinant protein is one that has a sequence that is not naturally occurring or has a sequence that is made by an artificial combination of two otherwise separated segments of sequence. In several embodiments, a recombinant protein is encoded by a heterologous (for example, recombinant) nucleic acid that has been introduced into a host cell, such as a bacterial or eukaryotic cell, or into the genome of a recombinant virus.

Self-assembling protein nanoparticle: A multi-subunit protein-based nanoparticle formed from subunit monomers that self-assemble under suitable conditions to form the nanoparticle (typically globular in shape). Non-limiting examples of self-assembling protein nanoparticles include ferritin nanoparticles (see, e.g., Zhang, Y. Int. J. Mol. Sci., 12:5406-5421, 2011, incorporated by reference herein), encapsulin nanoparticles (see, e.g., Sutter et al., Nature Struct. and Mol. Biol., 15:939-947, 2008, incorporated by reference herein), Sulfur Oxygenase Reductase (SOR) nanoparticles (see, e.g., Urich et al., Science, 311:996-1000, 2006, incorporated by reference herein), lumazine synthase nanoparticles (see, e.g., Zhang et al., *J. Mol. Biol.*, 306: 1099-1114, 2001), and pyruvate dehydrogenase nanoparticles (see, e.g., Izard et al., PNAS 96: 1240-1245, 1999, incorporated by reference herein). Ferritin, encapsulin, SOR, lumazine synthase, and pyruvate dehydrogenase are monomeric proteins that self-assemble into a globular protein complexes that in some cases consists of 24, 60, 24, 60, and 60 protein subunits, respectively. In some examples, ferritin, encapsulin, SOR, lumazine synthase, or pyruvate dehydrogenase subunits are fused to a disclosed heterologous carrier protein (such as an rTT, CRM197, or HiD carrier protein) and self-assembled into a protein nanoparticle presenting the carrier protein, which can subsequently be conjugated to HIV-1 Env fusion proteins to generate an immunogenic conjugate to elicit or prime an immune response to HIV-1 Env in a subject.

Sequence identity: The similarity between amino acid sequences is expressed in terms of the similarity between the sequences, otherwise referred to as sequence identity. Sequence identity is frequently measured in terms of percentage identity; the higher the percentage, the more similar the two sequences are. Homologs, orthologs, or variants of a polypeptide will possess a relatively high degree of sequence identity when aligned using standard methods.

Methods of alignment of sequences for comparison are well known in the art. Various programs and alignment algorithms are described in: Smith & Waterman, *Adv. Appl. Math.* 2:482, 1981; Needleman & Wunsch, *J. Mol. Biol.* 48:443, 1970; Pearson & Lipman, *Proc. Natl. Acad. Sci. USA* 85:2444, 1988; Higgins & Sharp, *Gene,* 73:237-44, 1988; Higgins & Sharp, *CABIOS* 5:151-3, 1989; Corpet et al., *Nuc. Acids Res.* 16:10881-90, 1988; Huang et al. *Computer Appls. In the Biosciences* 8, 155-65, 1992; and Pearson et al., *Meth. Mol. Bio.* 24:307-31, 1994. Altschul et al., *J. Mol. Biol.* 215:403-10, 1990, presents a detailed consideration of sequence alignment methods and homology calculations.

Variants of a polypeptide are typically characterized by possession of at least about 75%, for example, at least about 80%, 85%, 90%, 91%, 92%, 93%, 94%, 95%, 96%, 97%, 98% or 99% sequence identity counted over the full length alignment with the amino acid sequence of interest. Proteins with even greater similarity to the reference sequences will show increasing percentage identities when assessed by this method, such as at least 80%, at least 85%, at least 90%, at least 95%, at least 98%, or at least 99% sequence identity. When less than the entire sequence is being compared for sequence identity, homologs and variants will typically possess at least 80% sequence identity over short windows of 10-20 amino acids, and may possess sequence identities of at least 85% or at least 90% or 95% depending on their similarity to the reference sequence. Methods for determining sequence identity over such short windows are available at the NCBI website on the internet.

As used herein, reference to "at least 90% identity" (or similar language) refers to "at least 90%, at least 91%, at least 92%, at least 93%, at least 94%, at least 95%, at least 96%, at least 97%, at least 98%, at least 99%, or even 100% identity" to a specified reference sequence.

Signal Peptide: A short amino acid sequence (e.g., approximately 18-30 amino acids in length) that directs newly synthesized secretory or membrane proteins to and through membranes (for example, the endoplasmic reticulum membrane). Signal peptides are typically located at the N-terminus of a polypeptide and are removed by signal peptidases after the polypeptide has crossed the membrane. Signal peptide sequences typically contain three common structural features: an N-terminal polar basic region (n-region), a hydrophobic core, and a hydrophilic c-region). An exemplary signal peptide sequence is set forth as MDSKGSSQKGSRLLLLLVVSNLLLPQGVVA (SEQ ID NO: 220).

Specifically bind: When referring to the formation of an antibody:antigen protein complex, or a protein:protein complex, refers to a binding reaction which determines the presence of a target protein, peptide, or polysaccharide (for example, a glycoprotein), in the presence of a heterogeneous population of proteins and other biologics. Thus, under designated conditions, a particular antibody or protein binds preferentially to a particular target protein, peptide or polysaccharide (such as an antigen present on the surface of a pathogen, for example, gp120) and does not bind in a significant amount to other proteins or polysaccharides present in the sample or subject. Specific binding can be determined by standard methods. A first protein or antibody specifically binds to a target protein when the interaction has a $K_D$ of less than $10^{-6}$ Molar, such as less than $10^{-7}$ Molar, less than $10^{-8}$ Molar, less than $10^{-9}$, or even less than $10^{-10}$ Molar.

Subject: Living multicellular vertebrate organisms, a category that includes human and non-human mammals. In an example, a subject is a human. In a particular example, the subject is a newborn infant. In an additional example, a subject is selected that is in need of inhibiting of an HIV-1 infection. For example, the subject is either uninfected and at risk of HIV-1 infection or is infected in need of treatment.

Under conditions sufficient for: A phrase that is used to describe any environment that permits a desired activity.

Vaccine: A pharmaceutical composition that elicits a prophylactic or therapeutic immune response in a subject. In some cases, the immune response is a protective immune response. Typically, a vaccine elicits an antigen-specific immune response to an antigen of a pathogen, for example a viral pathogen, or to a cellular constituent correlated with a pathological condition. A vaccine may include a polynucleotide (such as a nucleic acid encoding a disclosed antigen), a peptide or polypeptide (such as a disclosed antigen), a virus, a cell or one or more cellular constituents. In one specific, non-limiting example, a vaccine reduces the severity of the symptoms associated with HIV-1 infection and/or decreases the viral load compared to a control. In another non-limiting example, a vaccine reduces HIV-1 infection compared to a control.

VRC34: An antibody that binds to the fusion peptide of HIV-1 any neutralizing HIV-1 infection. VRC34. Unless context indicates otherwise, "VRC34" refers to the VRC34.01 antibody disclosed by Kong et al. (Science, 352, 828-833, 2016). Sequences of the heavy and light chain variable regions of the VRC34.01 antibody are available, for example, as GenBank Accession Nos. ANF29805.1 and ANF29798.1, respectively, each of which is incorporated by reference herein. The VRC34 antibody can be used to assess the antigenicity fo the disclosed immunogenic conjugates of HIV-1 Env fusion peptides conjugated to a self-assembling protein nanoparticle carrier.

II. IMMUNOGENIC CONJUGATES

Immunogenic conjugates are provided herein that include HIV-1 Env fusion peptides conjugated to a self-assembling protein nanoparticle carrier. In several embodiments, the immunogenic conjugates can be used to generate a neutralizing immune response to HIV-1 in a subject, for example, to treat or prevent an HIV-1 infection in the subject. The immunogenic conjugate provides a multivalent platform with superior binding capability for engaging HIV-1 Env fusion peptide-directed broadly neutralizing antibodies and can be used, for example, to prime an immune response in a subject that targets the HIV-1 Env fusion peptide epitope. The components of the immunogenic conjugate are discussed in more detail below.

A. Self-Assembling Protein Nanoparticle Carrier

The immunogenic conjugates provided herein include HIV-1 Env fusion peptides conjugated to a self-assembling protein nanoparticle carrier. The self-assembling protein nanoparticle carrier is formed from a multimer of fusion proteins that each include a self-assembling protein nanoparticle subunit fused to a heterologous carrier protein. The subunit and the carrier protein can be directly fused (the C-terminus of one is linked by peptide bond to the N-terminus of the other) or indirectly fused via a peptide linker. Following expression of the fusion proteins (typically in a cellular system where the fusion proteins are secreted into the supernatant), the self-assembling protein nanoparticle subunits of the fusion proteins self-assemble under suitable conditions into the protein nanoparticle, forming a protein complex containing the protein nanoparticle and displaying the heterologous carrier proteins (at least one of which is fused to each self-assembling protein nanoparticle subunit). This protein complex is the self-assembling protein nanoparticle carrier to which HIV-1 Env fusion peptides are conjugated to form an immunogenic conjugate of the present disclosure.

1. Self-Assembling Protein Nanoparticle Subunit

The fusion proteins of the self-assembling protein nanoparticle carrier include a self-assembling protein nanoparticle subunit fused to a heterologous carrier protein. The self-assembling protein nanoparticle subunit is a monomer of a self-assembling protein nanoparticle, or a fragment of such a monomer that retains the portion of the monomer required for self-assembly. Non-limiting examples of self-assembling protein nanoparticle subunits that can be included in the fusion protein to form a self-assembling protein nanoparticle carrier include lumazine synthase nanoparticle subunits, ferritin nanoparticle subunts, encapsulin nanoparticle subunits, Sulfur Oxygenase Reductase (SOR) nanoparticle subunits, Bacteriophage Q Beta Capsid protein (qbeta) subunits, Dihydrolipoyl transacetylase protein (e2p) subunits, Phosphopantetheine Adenylyltransferase (6ccq) subunits, Glutamate Synthase (1f52) subunits, Calcium/calmodulin dependent protein kinase Ha (CaMKIIa), C-terminal fragment (5U6Y) subunits, HIV capsid oligomerization domain subunits, Hexamer subunits, and T4 fibritin Foldon domain (Fd) subunits. In a preferred embodiment, the self-assembling protein nanoparticle subunit included in the fusion protein is a ferritin subunit. In another preferred embodiment, the self-assembling protein nanoparticle subunit included in the fusion protein is a lumazine synthase subunit.

a. Ferritin

In some embodiments, any of the disclosed heterologous carrier proteins (such as an rTT, CRM197, or HiD carrier protein) can be linked to a ferritin subunit to construct a self-assembling ferritin nanoparticle carrier including a ferritin nanoparticle fused to a plurality of the heterologous carrier proteins. Ferritin nanoparticles and their use for immunization purposes (e.g., for immunization against influenza antigens) have been disclosed, for example, in Kanekiyo et al. (Nature, 499:102-106, 2013, incorporated by reference herein in its entirety). Ferritin is a globular protein that is found in all animals, bacteria, and plants, and which acts primarily to control the rate and location of polynuclear $Fe(III)_2O_3$ formation through the transportation of hydrated iron ions and protons to and from a mineralized core. Ferritin nanoparticles are formed from 24 copies of the ferritin subunit. The globular form of the ferritin nanoparticle is made up of monomeric subunits. Non-limiting examples of the sequence of self-assembling ferritin subunits for use in the embodiments provided herein include:

```
                                                   (SEQ ID NO: 14)
DIEKLLNEQVNKEMQSSNLYMSMSSWCYTHSLDGAGLFLFDHAAEEYEHAK

KLIIFLNENNVPVQLTSISAPEHKFEGLTQIFQKAYEHEQHISESINNIVD

HAIKSKDHATFNFLQWYVAEQHEEEVLFKDILDKIELIGNENHGLYLADQY

VKGIAKSRKS (SEQ ID NO: 15)
DIIKLLNEQVNKEMQSSNLYMSMSSWCYTHSLDGAGLFLFDHAAEEYEHAK

KLIIFLNENNVPVQLTSISAPHHKFHGLTHIFHKAYHHEQHISESINNIVD

HAIKSKDHATFNFLQWYVAEQHEEEVLFKDILDKIELIGNENHGLYLADQY

VKGIAKSRKS (SEQ ID NO: 16)
DIIKLLNEQVNKEMNSSNLYMSMSSWCYTHSLDGAGLFLFDHAAEEYEHAK

KLIIFLNENNVPVQLTSISAPEEKFEGLTQIFQKAYEHEQHISESINNIVD

HAIKSKDHATFNFLQWYVAEQHEEEVLFKDILDKIELIGNENHGLYLADQY

VKGIAKSRKS (SEQ ID NO: 17)
DIIKLLNEQVNKEMQSSNLYMSMSSWCYTHSLDGAGLFLFDHAAEEYEHAK

KLIIFLNENNVPVQLTSISAPEEKFEGLTQIFQKAYEHEQHISESINNIVD

HAIKSKDHATFNFLQWYVAEQHEEEVLFKDILDKIELIGNENHGLYLADQY

VKGIAKSRKS (SEQ ID NO: 18)
DIIKLLNEQVNKEMDSSNLYMSMSSWCYTHSLDGAGLFLFDHAAEEYEHAK

KLIIFLNENNVPVQLTSISAPEEKFEGLTQIFQKAYEHEQHISESINNIVD

HAIKSKDHATFNFLQWYVAEQHEEEVLFKDILDKIELIGNENHGLYLADQY

VKGIAKSRKS
``` and the following two sequences which include C-terminal truncations:

```
                                                   (SEQ ID NO: 19)
DIIKLLNEQVNKEMNSSNLYMSMSSWCYTHSLDGAGLFLFDHAAEEYEHAK

KLIIFLNENNVPVQLTSISAPEHKFEGLTQIFQKAYEHEQHISESINNIVD

HAIKSKDHATFNFLQWYVAEQHEEEVLFKDILDKIELIG (SEQ ID NO: 20)
DIIKLLNEQVNKEMNSSNLYMSMSSWCYTHSLDGAGLFLFDHAAEEYEHAK

KLIIFLNENNVPVQLTSISAPEHKFEGLTQIFQKAYEHEQHISESINNIVD

HAIKSKDHATFNFLQWYVAEQHEEEVLFKDILDKIELIGNEN
```

Additional ferritin subunits are provided with one or more cysteine substitutions to introduce non-native disulfide bond(s) that stabilize the ferritin nanoparticle formed from the self-assembled subunits. As used herein, a non-native disulfide bond introduced into a self-assembling protein nanoparticle subunit that "stabilizes" the nanoparticle formed from oligomerization of the subunit increases retention of the assembled nanoparticle compared to a control nanoparticle formed from subunits lacking the disulfide bond. The "stabilization" of the nanoparticle can be, for example, an increase in resistance to disassembly of the subunits compared to a corresponding native subunit sequence. Non-limiting examples of ferritin subunits are provided with one or more cysteine substitutions to introduce non-native disulfide bond(s) that stabilize the ferritin nanoparticle formed from the self-assembled subunits include:

```
Ferr_Hp_DS01
                                                                   (SEQ ID NO: 258)
MLSKDIIKLLNEQVNKEMQSSNLYMSMSCWCYTHSLDGAGLFLFDHAAEEYEHAKKLIIFLNENNVPCQLTSISAPEHKF

EGLTQIFQKAYEHEQHISESINNIVDHAIKSKDHCTFNFLQWYVAEQCEEEVLFKDILDKIELIGNENHGLYLADQYVKG

IAKSRKS

Ferr_Hp_DS02
                                                                   (SEQ ID NO: 259)
MLSKDIIKLLNEQVNKEMQSSNLYMSMSSWCYTHSLDGAGLFLFDHAAEEYEHAKKLIIFLNENNVPVQLTGCISAPEHK

FEGLTQIFQKAYEHEQHISESINNIVDHAIKSKDHCTFNFLQWYVAEQCEEEVLFKDILDKIELIGNENHGLYLADQYVK

GIAKSRKS

Ferr_Hp_DS03
                                                                   (SEQ ID NO: 260)
MLSKDIIKLLNEQVNKEMQSSNLYMSMSSWCYTHSLDGAGLFLFDHAAEEYEHAKKLIIFLNENNVPVQLTCISCPEHKF

EGLTQIFQKAYEHEQHISESINNIVDHAIKSKDHCTFNFLQWYVAEQCEEEVLFKDILDKIELIGNENHGLYLADQYVKG

IAKSRKS

Ferr_Hp_DS04
                                                                   (SEQ ID NO: 261)
MLSKDIIKLLNEQVNKEMQSSNLYMSMSSWCYTHSLDGAGLFLFDHAAEEYEHAKKLIIFLNENNVPVQLTSCSAPEHKF

EGLTQIFQKAYEHEQHISESINNIVDHAIKSKDHCTFNFLQWYVAEQCEEEVLFKDILDKIELIGNENHGLYLADQYVKG

IAKSRKS

Ferr_Hp_DS05
                                                                   (SEQ ID NO: 262)
MLSKDIIKLLNEQVNKEMQSSNLYMSMSCWCYTHSLDGAGLFLFDHAAEEYEHAKKLIIFLNCNNVPCQLTSISAPEHKF

EGLTQIFQKAYEHEQHISESINNIVDHAIKSKDHATFNFLQWYVAEQHEEECLFKDILDKIELIGNENHGLYLADQYVKG

IAKSRKS

Ferr_Hp_DS06
                                                                   (SEQ ID NO: 263)
MLSKDIIKLLNEQVNKEMQSSNLYMSMSSWCYTHSLDGAGLFLFDHAAEEYEHAKKLIIFLNQNNVPVQLTGCISAPEHK

FEGLTQIFQKAYEHEQHISESINNIVDHAIKSKDHATFNFLQWYVAEQHEEECLFKDILDKIELIGNENHGLYLADQYVK

GIAKSRKS

Ferr_Hp_DS07
                                                                   (SEQ ID NO: 264)
MLSKDIIKLLNEQVNKEMQSSNLYMSMSSWCYTHSLDGAGLFLFDHAAEEYEHAKKLIIFLNCNNVPVQLTCISPEHKF

EGLTQIFQKAYEHEQHISESINNIVDHAIKSKDHATFNFLQWYVAEQHEEELFKDILDKIELIGNENHGLYLADQYVKG

IAKSRKS

Ferr_Hp_DS08
                                                                   (SEQ ID NO: 265)
MLSKDIIKLLNEQVNKEMQSSNLYMSMSSWCYTHSLDGAGLFLFDHAAEEYEHAKKLIIFLNCNNVPVQLTSCSAPEHKF

EGLTQIFQKAYEHEQHISESINNIVDHAIKSKDHATFNFLQWYVAEQHEEECLFKDILDKIELIGNENHGLYLADQYVKG

IAKSRKS

Ferr_Hp_DS09
                                                                   (SEQ ID NO: 266)
MLSKDIIKLLNEQVNKEMQSSNLYMSMSCWCYTHSLDGAGLFLFDHAAEEYEHAKKLIIFLNENNVPQLTSISAPEHKF

EGLTQIFQKAYEHEQHISESINNI+32AIKSKDCATFNFLQWYVAEQHEEEVLFKDILDKIELIGNENHGLYLADQYVKG

IAKSRKS
```

-continued

Ferr_Hp_DS10
(SEQ ID NO: 267)
MLSKDIIKLLNEQVNKEMQSSNLYMSMSSWCYTHSLDGAGLFLFDHAAEEYEHAKKLIIFLNENNVPVQLTGCISAPEHK

FEGLTQIFQKAYEHEQHISESINNICDHAIKSKDCATFNFLQWYVAEQHEEEVLFKDILDKIELIGNENHGLYLADQYVK

GIAKSRKS

Ferr_Hp_DS11
(SEQ ID NO: 268)
MLSKDIIKLLNEQVNKEMQSSNLYMSMSSWCYTHSLDGAGLFLFDHAAEEYEHAKKLIIFLNENNVPVQLTCISPEHKF

EGLTQIFQKAYEHEQHISESINNICDHAIKSKDATFNFLQWYVAEQHEEEVLFKDILDKIELIGNENHGLYLADQYVKG

IAKSRKS

Ferr_Hp_DS12
(SEQ ID NO: 269)
MLSKDIIKLLNEQVNKEMQSSNLYMSMSSWCYTHSLDGAGLFLFDHAAEEYEHAKKLIIFLNENNVPVQLTSCSAPEHKF

EGLTQIFQKAYEHEQHISESINNICDHAIKSKDCATFNFLQWYVAEQHEEEVLFKDILDKIELIGNENHGLYLADQYVKG

IAKSRKS

Ferr_pf_DS01
(SEQ ID NO: 270)
MLSERMLKALNDQLNRELYSAYLYFAMACYFEDLGLEGFANWMKAQAEEEIGHALRFYNYIYCRNGRELDEIPKPPKEW

ESPLKAFEAAYEHEKFISKSIYELAALAEEEKDYSTRAFLEWFINEQVEEECSVKKILDKLKFAKDSPQILFMLDKELSA

RAPKLPGLLMQGGE

Ferr_pf_DS02
(SEQ ID NO: 271)
MLSERMLKALNDQLNRELYSAYLYFAMAAYFEDLGLEGFANWMKAQAEEEIGHALRFYNYIYCRNGRVELDCIPCPPKEW

ESPLKAFEAAYEHEKFISKSIYELAALAEEEKDYSTRAFLEWFINEQVEEECSVKKILDKLKFAKDSPQILFMLDKELSA

RAPKLPGLLMQGGE

Ferr_pf_DS03
(SEQ ID NO: 272)
MLSERMLKALNDQLNRELYSAYLYFAMAAYFEDLGLEGFANWMKAQAEEEIGHALRFYNYIYQRNGRVELDECPKPPKEW

ESPLKAFEAAYEHEKFISKSIYELAALAEEEKDYSTRAFLEWFINEQVEEECSVKKILDKLKFAKDSPQILFMLDKELSA

RAPKLPGLLMQGGE

Ferr_pf_DS04
(SEQ ID NO: 273)
MLSERMLKALNDQLNRELYSAYLYFAMAAYFEDLGLEGFANWMKAQAEEEIGHALRFYNYIYCRNGRVELDCIPKPPKEW

ESPLKAFEAAYEHEKFISKSIYELAALAEEEKDYSTRAFLEWFINEQVEEECSVKKILDKLKFAKDSPQILFMLDKELSA

RAPKLPGLLMQGGE

Ferr_pf_DS05
(SEQ ID NO: 274)
MLSERMLKALNDQLNRELYSAYLYFAMAAYFEDLGLEGFANWMKAQAEEEIGHALRFYNYIYCRNGRVELDGCIPKPPKE

WESPLKAFEAAYEHEKFISKSIYELAALAEEEKDYSTRAFLEWFINEQVEEECSVKKILDKLKFAKDSPQILFMLDKELS

ARAPKLPGLLMQGGE

Ferr_pf_DS06
(SEQ ID NO: 275)
MLSERMLKALNDQLNRELYSAYLYFAMAAYFEDLGLEGFANWMKAQAEEEIGHALRFYNYIYQRNGRVELDEIPKPPKEW

ESPLKAFEAAYEHEKFISKSIYELAALAEEEKDYSTRAFLEWFINEQVEEECSVKKILDKLKFAKDSPQILFMLDKELSA

RAPKLPGGC

Ferr_pf_DS07
(SEQ ID NO: 276)
MLSERMLKALNDQLNRELYSAYLYFAMAAYFEDLGLEGFANWMKAQAEEEIGHALRFYNYIYCRNGRVELDEIPKPPKEW

ESPLKAFEAAYEHEKFISKSIYELAALAEEEKDYSTRAFLEWFINEQVEEECSVKKILDKLKFAKDSPQILFMLDKELSA

RAPKLPGGGWC

-continued

Ferr_pf_DS08
(SEQ ID NO: 277)
MLSERMLKALNDQLNRELYSAYLYFAMACYFEDLGLEGFANWMKAQAEEEIGHALRFYNYIYDRNGRCELDEIPKPPKEW

ESPLKAFEAAYEHEKFISKSIYELAALAEEEKDCSTRAFLEWFCNEQVEEEASVKKILDKLKFAKDSPQILFMLDKELSA

RAPKLPGLLMQGGE

Ferr_pf_DS09
(SEQ ID NO: 278)
MLSERMLKALNDQLNRELYSAYLYFAMAAYFEDLGLEGFANWMKAQAEEEIGHALRFYNYIYDRNGRVELDCIPCPPKEW

ESPLKAFEAAYEHEKFISKSIYELAALAEEEKDCSTRAFLEWFCNEQVEEEASVKKILDKLKFAKDSPQILFMLDKELSA

RAPKLPGLLMQGGE

Ferr_pf_DS10
(SEQ ID NO: 279)
MLSERMLKALNDQLNRELYSAYLYFAMAAYFEDLGLEGFANWMKAQAEEEIGHALRFYNYIYDRNGRVELDECPKPPKEW

ESPLKAFEAAYEHEKFISKSIYELAALAEEEKDCSTRAFLEWFCNEQVEEEASVKKILDKLKFAKDSPQILFMLDKELSA

RAPKLPGLLMQGGE

Ferr_pf_DS11
(SEQ ID NO: 280)
MLSERMLKALNDQLNRELYSAYLYFAMAAYFEDLGLEGFANWMKAQAEEEIGHALRFYNYIYDRNGRVELDCIPKPPKEW

ESPLKAFEAAYEHEKFISKSIYELAALAEEEKDCSTRAFLEWFCNEQVEEEASVKKILDKLKFAKDSPQILFMLDKELSA

RAPKLPGLLMQGGE

Ferr_pf_DS12
(SEQ ID NO: 281)
MLSERMLKALNDQLNRELYSAYLYFAMAAYFEDLGLEGFANWMKAQAEEEIGHALRFYNYIYDRNGRVELDGCIPKPPKE

WESPLKAFEAAYEHEKFISKSIYELAALAEEEKDCSTRAFLEWFQNEQVEEEASVKKILDKLKFAKDSPQILFMLDKELS

ARAPKLPGLLMQGGE

Ferr_pf_DS13
(SEQ ID NO: 282)
MLSERMLKALNDQLNRELYSAYLYFAMAAYFEDLGLEGFANWMKAQAEEEIGHALRFYNYIYDRNGRVELDEIPKPPKEW

ESPLKAFEAAYEHEKFISKSIYELAALAEEEKDCSTRAFLEWFCNEQVEEEASVKKILDKLKFAKDSPQILFMLDKELSA

RAPKLPGGGC

Ferr_pf_DS14
(SEQ ID NO: 283)
MLSERMLKALNDQLNRELYSAYLYFAMAAYFEDLGLEGFANWMKAQAEEEIGHALRFYNYIYDRNGRVELDEIPKPPKEW

ESPLKAFEAAYEHEKFISKSIYELAALAEEEKDCSTRAFLEWFCNEQVEEEASVKKILDKLKFAKDSPQILFMLDKELSA

RAPKLPGGGWC

Ferr_Mt_DS01
(SEQ ID NO: 284)
MTEYEGPKTKFHALMQEQIHNEFTAAQQYVCIAVYFDSEDLPQLAKHFYSQAVEERNHAMMLVQHLLCRDLRVECPGVDT

VRNQFDRPREALALALDQERTVTDQVGRLTAVARDEGDFLGEQFMQWFLQEQIEEVCLMATLVRVADRAGANLFELENFV

AREVDVAPAASGAPHAAGGRL

Ferr_Mt_DS02
(SEQ ID NO: 285)
MTEYEGPKTKFHALMQEQIHNEFTAAQQYVAIAVYFDSEDLPQLAKHFYSQAVEERNHAMMLVQHLLCRDLRVEIPGCDT

VRNQFDRPREALALALDQERTVTDQVGRLTAVARDEGDFLGEQFMQWFLQEQIEEVCLMATLVRVADRAGANLFELENFV

AREVDVAPAASGAPHAAGGRL

Ferr_Mt_DS03
(SEQ ID NO: 286)
MTEYEGPKTKFHALMQEQIHNEFTAAQQYVAIAVYFDSEDLPQLAKHFYSQAVEERNHAMMLVQHLLCRDLRVCIPGVDT

VRCQFDRPREALALALDQERTVTDQVGRLTAVARDEGDFLGEQFMQWFLQEQIEEWLMATLVRVADRAGANLFELENFV

AREVDVAPAASGAPHAAGGRL

Ferr_Mt_DS04
(SEQ ID NO: 287)
MTEYEGPKTKFHALMQEQIHNEFTAAQQYVAIAVYFDSEDLPQLAKHFYSQAVEERNHAMMLVQHLLCRDLRVEIPGVDT
VRNQFDRPREALALALDQERTVTDQVGRLTAVARDEGDFLGEQFMQWFLQEQIEEVCLMATLVRVADRAGANLFELENFV
AREVDVAPAASGAPHAAGGRC Ferr_Mt_DS05
(SEQ ID NO: 288)
MTEYEGPKTKFHALMQEQIHNEFTAAQQYVAIAVYFDSEDLPQLAKHFYSQAVEERNHAMMLVQHLLCRDLRVEIPGVDT
VRNQFDRPREALALALDQERTVTDQVGRLTAVARDEGDFLGEQFMQWFLQEQIEEVCLMATLVRVADRAGANLFELENFV
AREVDVAPAASGAPHAAGGRC Ferr_Mt_DS06
(SEQ ID NO: 289)
MTEYEGPKTKFHALMQEQIHNEFTAAQQYVCIAVYFDSEDLPQLAKHFYSQAVEERNHAMMLVQHLLDRDLRVECPGVDT
VRNQFDRPREALALALDQERTVTDQVGRLCAVARDEGDCLGEQFMQWFLQEQIEEVALMATLVRVADRAGANLFELENFV
AREVDVAPAASGAPHAAGGRL Ferr_Mt_DS07
(SEQ ID NO: 290)
MTEYEGPKTKFHALMQEQIHNEFTAAQQYVAIAVYFDSEDLPQLAKHFYSQAVEERNHAMMLVQHLLDRDLRVEIPGCDT
VRNQFDRPREALALALDQERTVTDQVGRLQAVARDEGDLGEQFMQWFLQEQIEEVALMATLVRVADRAGANLFELENFV
AREVDVAPAASGAPHAAGGRL Ferr_Mt_DS08
(SEQ ID NO: 291)
MTEYEGPKTKFHALMQEQIHNEFTAAQQYVAIAVYFDSEDLPQLAKHFYSQAVEERNHAMMLVQHLLDRDLRVCIPGVDT
VRCQFDRPREALALALDQERTVTDQVGRLCAVARDEGDCLGEQFMQWFLQEQIEEVALMATLVRVADRAGANLFELENFV
AREVDVAPAASGAPHAAGGRL Ferr_Mt_DS09
(SEQ ID NO: 292)
MTEYEGPKTKFHALMQEQIHNEFTAAQQYVAIAVYFDSEDLPQLAKHFYSQAVEERNHAMMLVQHLLDRDLRVEIPGVDT
VRNQFDRPREALALALDQERTVTDQVGRLAVARDEGDQLGEQFMQWFLQEQIEEVALMATLVRVADRAGANLFELENFV
AREVDVAPAASGAPHAAGGR Ferr_Mt_DS10
(SEQ ID NO: 293)
MTEYEGPKTKFHALMQEQIHNEFTAAQQYVAIAVYFDSEDLPQLAKHFYSQAVEERNHAMMLVQHLLDRDLRVEIPGVDT
VRNQFDRPREALALALDQERTVTDQVGRLCAVARDEGDCLGEQFMQWFLQEQIEEVALMATLVRVADRAGANLFELENFV
AREVDVAPAASGAPHAAGGRG Ferr_ec_DS01
(SEQ ID NO: 294)
MLKPEMIEKLNEQMNLELYSSLLYQQMSAW+32HTFEGAAAFLRRHAQEEMTHMQRLFDYLCDTGNLPRINTVESPFAEY
SSLDELFQETYKHEQLITQKINELCHAAMTNQDCPTFNFLQWYVSEQHEEEKLFKSIIDKLSLAGKSGEGLYFIDKELST
LDTQN Ferr_ec_DS02
(SEQ ID NO: 295)
MLKPEMIEKLNEQMNLELYSSLLYQQMSAWCSYHTFEGAAAFLRRHAQEEMTHMQRLFDYLTDTGNLPRINCVECPFAEY
SSLDELFQETYKHEQLITQKINELHAAMTNQDCPTFNFLQWYVSEQHEEEKLFKSIIDKLSLAGKSGEGLYFIDKELST
LDTQN Ferr_ec_DS03
(SEQ ID NO: 296)
MLKPEMIEKLNEQMNLELYSSLLYQQMSAWCSYHTFEGAAAFLRRHAQEEMTHMQRLFDYLTDTGNLPRINTCESPFAEY
SSLDELFQETYKHEQLITQKINELCHAAMTNQDCPTFNFLQWYVSEQHEEEKLFKSIIDKLSLAGKSGEGLYFIDKELST
LDTQN Ferr_ec_DS04

(SEQ ID NO: 297)
MLKPEMIEKLNEQMNLELYSSLLYQQMSAW+32HTFEGAAAFLRRHAQEEMTHMQRLFDYLCDTGNLPRINTVESPFAEYSSLDELFQETYKHEQLITQKINELAHAAMTNQDYQTFNFLQWYCSEQHEEEKLFKSIIDKLSLAGKSGEGLYFIDKELSTLDTQN

Ferr_ec_DS05

(SEQ ID NO: 298)
MLKPEMIEKLNEQMNLELYSSLLYQQMSAWCSYHTFEGAAAFLRRHAQEEMTHMQRLFDYLTDTGNLPRINCVECPFAEYSSLDELFQETYKHEQLITQKINELAHAAMTNQDYCTFNFLQWYSEQHEEEKLFKSIIDKLSLAGKSGEGLYFIDKELSTLDTQN

Ferr_ec_DS06

(SEQ ID NO: 299)
MLKPEMIEKLNEQMNLELYSSLLYQQMSAWCSYHTFEGAAAFLRRHAQEEMTHMQRLFDYLTDTGNLPRINTCESPFAEYSSLDELFQETYKHEQLITQKINELAHAAMTNQDYCTFNFLQWWSEQHEEEKLFKSIIDKLSLAGKSGEGLYFIDKELSTLDTQN

Ferr_ec_DS07

(SEQ ID NO: 300)
MLKPEMIEKLNEQMNLELYSSLLYQQMSAWCCYHTFEGAAAFLRRHAQEEMTHMQRLFDYLCDTGNLPRINTVESPFAEYSSLDELFQETYKHEQLITQKINELAHAAMTNQD+32FNFLQWYVSEQEEEKLFKSIIDKLSLAGKSGEGLYFIDKELSTLDTQN

Ferr_ec_DS08

(SEQ ID NO: 301)
MLKPEMIEKLNEQMNLELYSSLLYQQMSAWCCYHTFEGAAAFLRRHAQEEMTHMQRLFDYLQDTGNLPRINTVESPFAEYSSLDELFQETYKHEQLITQKINELAHAAMTNQDYQTFNFLQWYVSEQCGEEEKLFKSIIDKLSLAGKSGEGLYFIDKELSTLDTQN

Ferr_ec_DS09

(SEQ ID NO: 302)
MLKPEMIEKLNEQMNLELYSSLLYQQMSAWCSYHTFEGAAAFLRRHAQEEMTHMQRLFDYLTDTGNLPRINCVECPFAEYSSLDELFQETYKHEQLITQKINELAHAAMTNQDYCTFNFLQWYVSEQCEEEKLFKSIIDKLSLAGKSGEGLYFIDKELSTLDTQN

Ferr_ec_DS10

(SEQ ID NO: 303)
MLKPEMIEKLNEQMNLELYSSLLYQQMSAWCSYHTFEGAAAFLRRHAQEEMTHMQRLFDYLTDTGNLPRINCVECPFAEYSSLDELFQETYKHEQLITQKINELAHAAMTNQDYCTFNFLQWYVSEQCEEEKLFKSIIDKLSLAGKSGEGLYFIDKELSTLDTQN

Ferr_ec_DS11

(SEQ ID NO: 304)
MLKPEMIEKLNEQMNLELYSSLLYQQMSAWCSYHTFEGAAAFLRRHAQEEMTHMQRLFDYLTDTGNLPRINTQESPFAEYSSLDELFQETYKHEQLITQKINELAHAAMTNQDYCTFNFLQWYVSEQCEEEKLFKSIIDKLSLAGKSGEGLYFIDKELSTLDTQN

Ferr_frog_DS01

(SEQ ID NO: 305)
MVSQCRQNYHSDCEAAVNRMLNLELYASYTYSSMYCFFDRDDVALHNVAEFFKEHSHEEREHAEKFMKYQNKRGGRCVLQDIKKPERDEWGNTLEAMQAALQLEKTVNQALLDLHKLATDKVDPHLCDFLESEYLEEQVKDIKRICDFITNLKRLGLPENGMGEYLFDKHSVKESS

In some embodiments, the fusion proteins of the self-assembling protein nanoparticle carrier comprise any of the disclosed heterologous carrier proteins fused to a ferritin subunit including an amino acid sequence at least 80% (such as at least 85%, at least 90%, at least 95%, or at least 97%) identical to amino acid sequence set forth as any one of SEQ ID NOs: 14-20 or 258-305.

In additional embodiments, any of the disclosed heterologous carrier proteins can be linked to an insect ferritin subunit to construct the self-assembling ferritin nanoparticle carrier including the ferritin nanoparticle fused to the plurality of the heterologous carrier proteins. Insect ferritin protein nanopartciles and their use and production are described, for example, in PCT. Pub. No. WO 2018/005558, which is incorporated by reference herein. Unlike bacterial ferritin, insect ferritin includes twelve copies of two different subunits (termed heavy and light chains; 24 subunits total). The insect ferritin heavy chains trimerize and the insect ferritin light chains trimerize (forming four trimers of heavy chains and four trimers of light chains) and self-assemble into the globular nanoparticle. In several embodiments, each insect ferritin heavy chain includes an N-terminal fusion to a first heterologous carrier protein, and each insect ferritin light chain includes an N-terminal fusion to a second heterologous carrier protein. This allows for display of two diverse carrier proteins on the same ferritin nanoparticle.

In several embodiments, the insect ferritin heavy and light chains can be from the *Lepidoptera* order of insects, such as ferritin heavy and light chains from *Trichoplusia* (such as *Trichoplusia ni*), or ferritin heavy and light chains from *Manduca*. Exemplary ferritin heavy and light chain amino acid sequences for *Trichoplusia ni* and *Manduca* proteins are provided below:

Exemplary insect ferritin heavy and light chain sequences with N-terminal truncations that can be included in the fusion protein are set forth below:

```
Trichoplusia ni ferritin heavy chain with
18-aa N-terminal truncation (nt19)
                                           (SEQ ID NO: 21)
RSCRNSMRQQIQMEVGASLQYLAMGAHFSKDVVNRPGFAQLFFDAASEER

EHAMKLIEYLLMRGELTNDVSSLLQVRPPTRSSWKGGVEALEHALSMESD

VTKSIRNVIKACEDDSEFNDYHLVDYLTGDFLEEQYKGQRDLAGKASTLK

KLMDRHEALGEFIFDKKLLGIDV

Trichoplusia ni ferritin light chain with
29-aa N-terminal truncation (nt30)
                                           (SEQ ID NO: 22)
EYGSHGNVATELQAYAKLHLERSYDYLLSAAYFNNYQTNRAGFSKLFKKL

SDEAWSKTIDIIKHVTKRGDKMNFDQHSTMKTERKNYTAENHELEALAKA

LDTQKELAERAFYIHREATRNSQHLHDPEIAQYLEEEFIEDHAEKIRTLA

GHTSDLKKFITANNGHDLSLALYVFDEYLQKTV

Manduca ferritin heavy chain with 38-aa
truncation (nt39)
                                           (SEQ ID NO: 23)
RSCRDSMRRQIQMEVGASLQYLAMGAHFSKDKINRPGFAKLFFDAAGEER

EHAMKLIEYLLMRGELTNDVTSLIQVRAPQRNKWEGGVDALEHALKMESD

VTKSIRTVIKACEDDPEFNDYHLVDYLTGEFLEEQYKGQRDLAGKASTLK

KMLDRNSALGEFIFDKKLMGMDI

Manduca ferritin light chain with 48-aa
N-terminal truncation (nt49)
                                           (SEQ ID NO: 24)
EYGHHGNVAKEMQAYAALHLERSYEYLLSSSYFNNYQTNRAGFSKLFRKL

SDDAWEKTIDLIKHITMRGDEMNFAQRSTQKSVDRKNYTVELHELESLAK

ALDTQKELAERAFFIHREATRNSQHLHDPEVAQYLEEEFIEDHAKTIRNL

AGHTTDLKRFVSGDNGQDLSLALYVFDEYLQKTV
```

In some embodiments, the insect ferritin heavy chain can be a *Trichoplusia ni* ferritin heavy chain with an 18 amino acid N-terminal truncation and the insect ferritin light chain can be a *Trichoplusia ni* ferritin light chain with a 29 amino acid N-terminal truncation. For example, the insect ferritin heavy chain comprises an amino acid sequence at least 90% identical to SEQ ID NO: 21, and the insect ferritin light chain comprises an amino acid sequence at least 90% identical SEQ ID NO: 22 In some embodiments, the insect ferritin heavy chain comprises an amino acid sequence set forth as SEQ ID NO: 21, and the insect ferritin light chain comprises an amino acid sequence set forth as SEQ ID NO: 22.

In some embodiments, the insect ferritin heavy chain can be a *Manduca* ferritin heavy chain with a 38 amino acid N-terminal truncation and the insect ferritin light chain can be a *Manduca* ferritin light chain with a 48 amino acid N-terminal truncation. For example, the insect ferritin heavy chain comprises an amino acid sequence at least 90% identical to SEQ ID NO: 23, and the insect ferritin light chain comprises an amino acid sequence at least 90% identical to SEQ ID NO: 24. In some embodiments, the insect ferritin heavy chain comprises an amino acid sequence set forth as SEQ ID NO: 23, and the insect ferritin light chain comprises an amino acid sequence set forth as SEQ ID NO: 24.

b. Lumazine Synthase (LS)

In some embodiments, any of the disclosed heterologous carrier proteins (such as an rTT, CRM197, or HiD carrier protein) can be linked to a lumazine synthase subunit to construct a self-assembling lumazine synthase nanoparticle carrier including a lumazine synthase nanoparticle fused to a plurality of the heterologous carrier proteins. Lumazine synthase nanoparticles are formed from 60 copies of the lumazine synthase subunit.

The globular form of lumazine synthase nanoparticle is made up of monomeric subunits; non-limiting examples of the sequence of lumazine synthase subunits are provided as:

```
                                           (SEQ ID NO: 25)
MQIYEGKLTAEGLRFGIVASRFNHALVDRLVEGAIDAIVRHGGREEDITL

VRVPGSWEIPVAAGELARKEDIDAVIAIGVLIRGATPHFDYIASEVSKGL

ADLSLELRKPITFGVITADTLEQAIERAGTKHGNKGWEAALSAIEMANLF

KSLR (SEQ ID NO: 26)
QIYEGKLTAEGLRFGIVASRFNHALVDRLVEGCIDCIVRHGGREEDITLV

RVPGSWEIPVAAGELARKEDIDAVIAIGVLIRGATPHFDYIASEVSKGLA

NLSLELRKPITFGVITADTLEQAIERAGTKHGNKCWEAALSAIEMANLFK

SLR (SEQ ID NO: 27)
QIYEGKLTAEGLRFGIVASRFNHALVDRLVEGAIDAIVRHGGREEDITLV

RVPGSWEIPVAAGELARKENISAVIAIGVLIRGATPHFDYIASEVSKGLA

DLSLELRKPITFGVITADTLEQAIERAGTKHGNKGWEAALSAIEMANLFK

SLR (SEQ ID NO: 28)
QIYEGKLTAEGLRFGIVASRFNHALVDRLVEGAIDCIVRHGGREEDITLV

RVPGSWEIPVAAGELARKEDIDAVIAIGVLIRGATPHFDYIASEVSKGLA

DLSLELRKPITFGVITADTLEQAIERAGTKHGNKGWEAALSAIEMANLFK

SLR
```

Additional lumazine synthase subunits are provided with one or more cysteine substitutions to introduce non-native disulfide bond(s) that stabilize the lumazine synthase nanoparticle formed from self-assembled subunits. In some embodiments, the non-native disulfide bond(s) are introduced with L121C-K131C, L121CG-K131C, L121GC- K131C, K7C-R40C, I3C-L50C, I82C-K131CG, E5C-R52C, or E95C-A101C substitutions, or a combination thereof (such as I3C-L50C and I82C-K131CG; E5C-R52C and I82C-K131CG; or E95C-A101C and I82C-K131CG). The residues numbering is with reference to the lumazine synthase subunit set forth as SEQ ID NO: 25. Non-limiting examples include:

LS-L121C-K131C
(SEQ ID NO: 306)
QIYEGKLTAEGLRFGIVASRFNHALVDRLVEGAIDAIVRHGGREEDITLV

RVPGSWEIPVAAGELARKEnIsAVIAIGVLIRGATPHFDYIASEVSKGLA

DLSLELRKPITFGVITADTcEQAIERAGTcHGNKGWEAALSAIEMANLFK

SLR

LS-L121CG-K131C
(SEQ ID NO: 307)
QIYEGKLTAEGLRFGIVASRFNHALVDRLVEGAIDAIVRHGGREEDITLV

RVPGSWEIPVAAGELARKEnIsAVIAIGVLIRGATPHFDYIASEVSKGLA

DLSLELRKPITFGVITADTcgEQAIERAGTcHGNKGWEAALSAIEMANLF

KSLR

LS-L121GC-K131C
(SEQ ID NO: 308)
QIYEGKLTAEGLRFGIVASRFNHALVDRLVEGAIDAIVRHGGREEDITLV

RVPGSWEIPVAAGELARKEnIsAVIAIGVLIRGATPHFDYIASEVSKGLA

DLSLELRKPITFGVITADTgcEQAIERAGTcHGNKGWEAALSAIEMANLF

KSLR

LS-K7C-R40C
(SEQ ID NO: 309)
QIYEGcLTAEGLRFGIVASRFNHALVDRLVEGAIDAIVcHGGREEDITLV

RVPGSWEIPVAAGELARKEnIsAVIAIGVLIRGATPHFDYIASEVSKGLA

DLSLELRKPITFGVITADTLEQAIERAGTKHGNKGWEAALSAIEMANLFK

SLR

LS_Aq_DS01 (I3C-L50C, I82C-K131CG)
(SEQ ID NO: 310)
QCYEGKLTAEGLRFGIVASRFNHALVDRLVEGAIDCIVRHGGREEDITCV

RVPGSWEIPVAAGELARKEDIDAVIAIGVLCRGATPHFDYIASEVSKGLA

DLSLELRKPITFGVITADTLEQAIERAGTCGHGNKGWEAALSAIEMANLF

KSLR

LS_Aq_DS02 (E5C-R52C, I82C-K131CG)
(SEQ ID NO: 311)
QIYCGKLTAEGLRFGIVASRFNHALVDRLVEGAIDCIVRHGGREEDITLV

CVPGSWEIPVAAGELARKEDIDAVIAIGVLCRGATPHFDYIASEVSKGLA

DLSLELRKPITFGVITADTLEQAIERAGTCGHGNKGWEAALSAIEMANLF

KSLR

LS_Aq_DS03 (E95C-A101C, I82C-K131CG)
(SEQ ID NO: 312)
QIYEGKLTAEGLRFGIVASRFNHALVDRLVEGAIDCIVRHGGREEDITLV

RVPGSWEIPVAAGELARKEDIDAVIAIGVLCRGATPHFDYIASCVSKGLC

DLSLELRKPITFGVITADTLEQAIERAGTCGHGNKGWEAALSAIEMANLF

KSLR

In some embodiments, the fusion proteins of the self-assembling protein nanoparticle carrier comprise any of the disclosed heterologous carrier proteins fused to a lumazine synthase subunit including an amino acid sequence at least 80% (such as at least 85%, at least 90%, at least 95%, or at least 97%) identical to amino acid sequence set forth as any one of SEQ ID NOs: 25-28 or 306-312.

c. DNA Starvation/Stationary Phase Protection Protein (DPS)

In some embodiments, any of the disclosed heterologous carrier proteins (such as an rTT, CRM197, or HiD carrier protein) can be linked to a subunit of a DNA starvation/stationary phase protection protein (DPS) complex, such as a DPS subunit from *Thermosynechococcus elongates*, *Kineococcuc radiotolerans*, or *Nostoc punctiforme*, to construct a self-assembling DPS nanoparticle carrier including a DPS nanoparticle fused to a plurality of the heterologous carrier proteins. Non-limiting examples of the sequence of DPS subunits that can be included in the fusion proteins of the self-assembling protein nanoparticle carrier are provided as:

DNA starvation/stationary phase protection protein
(*Thermosynechococcus elongates*)
(SEQ ID NO: 29)
SATTTLKEQVLTTLKREQANAVVMYLNYKKYHWLTYGPLFRDLHLLFEEQ

GSEVFAMIDELAERSLMLDGQPVADPADYLKVATVTPSSGQLTVKQMIEE

AIANHELIITEMHQDAEIATEAGDIGTADLYTRLVQTHQKHRWFLKEFLA

KGDGLVS

DNA starvation/stationary phase protection protein
(*Kineococcuc radiotolerans*)
(SEQ ID NO: 30)
TTIHDVQTTGLTQDAVTGFDASSRLNAGLQEVLVDLTALHLQGKQAHWNI

VGENWRDLHLQLDTLVEAARGFSDDVAERMRAVGGVPDARPQTVAASRIG

DVGPDEIDTRACVEAIVALVRHTVDTIRRVHDPIDAEDPASADLLHAITL

ELEKQAWMIGSENRSPRR

DNA starvation/stationary phase protection protein
(*Nostoc punctiforme*)
(SEQ ID NO: 31)
SETQTLLRNFGNVYDNPVLLDRSVTAPVTEGFNVVLASFQALYLQYQKHH

FVVEGSEFYSLHEFFNEAYNQVQDHIHEIGERLDGLGGVPVATFSKLAEL

TCFEQESEGVYSSRQMVENDLAAEQAIIGVIRRQAAQAESLGDRGTRYLY

EKILLKTEERAYHLSHFLAKDSLTLGFVQAAQS

In some embodiments, the fusion proteins of the self-assembling protein nanoparticle carrier comprise any of the disclosed heterologous carrier proteins fused to a DPS subunit including an amino acid sequence at least 80% (such as at least 85%, at least 90%, at least 95%, or at least 97%) identical to amino acid sequence set forth as any one of SEQ ID NOs: 29-31.

d. Bacteriophage Q Beta Capsid Protein (qbeta)

In some embodiments, any of the disclosed heterologous carrier proteins (such as an rTT, CRM197, or HiD carrier protein) can be linked to a subunit of a Bacteriophage Q Beta Capsid protein (qbeta) complex to construct a self-assembling qbeta nanoparticle carrier including a qbeta nanoparticle fused to a plurality of the heterologous carrier proteins. A non-limiting example of the sequence of a qbeta subunit that can be included in the fusion proteins of the self-assembling protein nanoparticle carrier is provided as:

(SEQ ID NO: 32)
AKLETVTLGNIGKDGKQTLVLNPRGVNPTNGVASLSQAGAVPALEKRVTV

SVSQPSRNRKNYKVQVKIQNPTACTANGACDPSVTRQAYADVTFSFTQYS

TDEERAFVRTELAALLASPLLIDAIDQLNPAY

In some embodiments, the fusion proteins of the self-assembling protein nanoparticle carrier comprise any of the disclosed heterologous carrier proteins fused to a qbeta subunit including an amino acid sequence at least 80% (such as at least 85%, at least 90%, at least 95%, or at least 97%) identical to the amino acid sequence set forth as SEQ ID NO: 32.

e. Dihydrolipoyl Transacetylase Protein (e2p)

In some embodiments, any of the disclosed heterologous carrier proteins (such as an rTT, CRM197, or HiD carrier protein) can be linked to a subunit of a dihydrolipoyl transacetylase protein (e2p) complex to construct a self-assembling e2p nanoparticle carrier including an e2p nanoparticle fused to a plurality of the heterologous carrier proteins. E2p nanoparticles are formed from 60 copies of the e2p subunit; structural information is deposited at the Protein Data Bank No. 1B5S. In the globular e2p nanoparticle, the N-terminus of the subunit is surface exposed and the C-terminus of the subunit is inside the globular nanoparticle. A non-limiting example of the sequence of an ep2 subunit that can be included in the fusion proteins of the self-assembling protein nanoparticle carrier is provided as:

(SEQ ID NO: 33)
AAAKPATTEGEFPETREKMSGIRRAIAKAMVHSKHTAPHVTLMDEADVTK

LVAHRKKFKAIAAEKGIKLTFLPYVVKALVSALREYPVLNTAIDDETEEI

IQKHYYNIGIAADTDRGLLVPVIKHADRKPIFALAQEINELAEKARDGKL

TPGEMKGASCTITNIGSAGGQWFTPVINHPEVAILGIGRIAEKPIVRDGE

IVAAPMLALSLSFDHRMIDGATAQKALNHIKRLLSDPELLLM

In some embodiments, the fusion proteins of the self-assembling protein nanoparticle carrier comprise any of the disclosed heterologous carrier proteins fused to an e2p subunit including an amino acid sequence at least 80% (such as at least 85%, at least 90%, at least 95%, or at least 97%) identical to the amino acid sequence set forth as SEQ ID NO: 33.

f. Phosphopantetheine Adenylyltransferase (6ccq)

In some embodiments, any of the disclosed heterologous carrier proteins (such as an rTT, CRM197, or HiD carrier protein) can be linked to a subunit of a Phosphopantetheine Adenylyltransferase (6ccq) complex to construct a self-assembling 6ccq nanoparticle carrier including a 6ccq nanoparticle fused to a plurality of the heterologous carrier proteins. Phosphopantetheine Adenylyltransferase nanoparticles are formed from 6 copies of the Phosphopantetheine Adenylyltransferase subunit; structural information is deposited at the Protein Data Bank No. 6CCQ. A non-limiting example of the sequence of a 6ccq subunit that can be included in the fusion proteins of the self-assembling protein nanoparticle carrier is provided as:

(SEQ ID NO: 34)
MQKRAIYPGTFDPITNGHIDIVTRATQMFDHVILAIAASPSKKPMFTLEE

RVALAQQATAHLGNVEVVGFSDLMANFARNQHATVLIRGLRAVADFEYEM

-continued

QLAHMNRHLMPELESVFLMPSKEWSFISSSLVKEVARHQGDVTHFLPENV

HQALMAKLAVD

In some embodiments, the fusion proteins of the self-assembling protein nanoparticle carrier comprise any of the disclosed heterologous carrier proteins fused to a 6ccq subunit including an amino acid sequence at least 80% (such as at least 85%, at least 90%, at least 95%, or at least 97%) identical to the amino acid sequence set forth as SEQ ID NO: 34.

g. Glutamate Synthase (1f52)

In some embodiments, any of the disclosed heterologous carrier proteins (such as an rTT, CRM197, or HiD carrier protein) can be linked to a subunit of a Glutamate Synthase (1f52) protein complex to construct a self-assembling Glutamate Synthase nanoparticle carrier including a Glutamate Synthase nanoparticle fused to a plurality of the heterologous carrier proteins. A non-limiting example of the sequence of a Glutamate Synthase subunit that can be included in the fusion proteins of the self-assembling protein nanoparticle carrier is provided as:

(SEQ ID NO: 35)
EHVLTMLNEHEVKFVDLRFTDTKGKEQHVTIPAHQVNAEFFEEGKMFDGS

SIGGWKGINESDMVLMPDASTAVIDPFFADSTLIIRCDILEPGTLQGYDR

DPRSIAKRAEDYLRATGIADTVLFGPEPEFFLFDDIRFGASISGSHVAID

DIEGAWNSSTKYEGGNKGHRPGVKGGYFPVPPVDSAQDIRSEMCLVMEQM

GLVVEAHHHEVATAGQNEVATRFNTMTKKADEIQIYKYVVHNVAHRFGKT

ATFMPKPMFGDNGSGMHCHMSLAKNGTNLFSGDKYAGLSEQALYYIGGVI

KHAKAINALANPTTNSYKRLVPGYEAPVMLAYSARNRSASIRIPVVASPK

ARRIEVRFPDPAANPYLCFAALLMAGLDGIKNKIHPGEPMDKNLYDLPPE

EAKEIPQVAGSLEEALNALDLDREFLKAGGVFTDEAIDAYIALRREEDDR

VRMTPHPVEFELYYSV

In some embodiments, the fusion proteins of the self-assembling protein nanoparticle carrier comprise any of the disclosed heterologous carrier proteins fused to a Glutamate Synthase subunit including an amino acid sequence at least 80% (such as at least 85%, at least 90%, at least 95%, or at least 97%) identical to the amino acid sequence set forth as SEQ ID NO: 35.

h. Calcium/Calmodulin Dependent Protein Kinase IIa (CaMKIIa), C-Terminal Fragment (5U6Y)

In some embodiments, any of the disclosed heterologous carrier proteins (such as an rTT, CRM197, or HiD carrier protein) can be linked to a c-terminal fragment of a Calcium/calmodulin dependent protein kinase IIa (CaMKIIa) protein to construct a self-assembling CaMKIIa nanoparticle carrier including a nanoparticle based on the C-terminal fragment of CaMKIIa fused to a plurality of the heterologous carrier proteins. The CaMKIIa nanoparticle is formed from 12 copies of the c-terminal fragment of CaMKIIa subunit; structural information is deposited at the Protein Data Bank No. 5U6Y. The N-terminus of the c-terminal fragment is surface exposed in the globular nanoparticle. Non-limiting examples of CaMKIIa sequences that can be included in the fusion proteins of the self-assembling protein nanoparticle carrier are provided as:

(SEQ ID NO: 36)
GGKSGGNKKSDGVKESSESTNTAIEDEDTKVRKQEIIKVTEQLIEAISNG
DFESYTKMCDPGMTAFEPEALGNLVEGLDFHRFYFENLWSRNSKPVHTTI
LNPHIHLMGDESACIAYIRITQYLDAGGIPRTAQSEETRVWHRRDGKWQI
VHFHRSGA (SEQ ID NO: 37)
GVKESSESTNTAIEDEDTKVRKQEIIKVTEQLIEAISNGDFESYTKMCDP
GMTAFEPEALGNLVEGLDFHRFYFENLWSRNSKPVHTTILNPHIHLMGDE
SACIAYIRITQYLDAGGIPRTAQSEETRVWHRRDGKWQIVHFHRSGA (SEQ ID NO: 38)
STNTAIEDEDTKVRKQEIIKVTEQLIEAISNGDFESYTKMCDPGMTAFEP
EALGNLVEGLDFHRFYFENLWSRNSKPVHTTILNPHIHLMGDESACIAYI
RITQYLDAGGIPRTAQSEETRVWHRRDGKWQIVHFHRSGA

In some embodiments, the fusion proteins of the self-assembling protein nanoparticle carrier comprise any of the disclosed heterologous carrier proteins fused to a Glutamate Synthase subunit including an amino acid sequence at least 80% (such as at least 85%, at least 90%, at least 95%, or at least 97%) identical to the amino acid sequence set forth as any one of SEQ ID NOs: 36-38.

i. HIV Capsid Oligomerization Domain (HIV)

In some embodiments, any of the disclosed heterologous carrier proteins (such as an rTT, CRM197, or HiD carrier protein) can be linked to a HIV capsid oligomoization domain (HIV) to construct a self-assembling HIV capsid oligomerization domain nanoparticle carrier including a nanoparticle based on the HIV capsid oligomerization domain fused to a plurality of the heterologous carrier proteins. Non-limiting examples of HIV capsid oligomerization domain sequences that can be included in the fusion proteins of the self-assembling protein nanoparticle carrier are provided as:

(SEQ ID NO: 39)
PIVQNLQGQMVHQAISCLCLNAWVKVVEEKAFSPEVIPMFSALSEGATPQ
DLNTMLNTVGGHQAAMQMLKETINEEAAEWDRLHPVHAGPIAPGQMREPR
GSDIAGTTSTLQEQIGWMTHNPPIPVGEIYKRWIILGLNKIVRMYSPTSI
LDIRQGPKEPFRDYVDRFYKTLRAEQASQEVKNAATETLLVQNANPDCKT
ILKALGPGATLEEMMTACQGVGGPGHKARV (SEQ ID NO: 40)
PIVQNLQGQMVHQAISCLCLNAWVKVVEEKAFSPEVIPMFSALSEGATPQ
DLNTMLNTVGGHQAAMQMLKETINEEAAEWDRLHPVHAGPIAPGQMREPR
GSDIAGTTSTLQEQIGWMTHNPPIPVGEIYKRWIILGLNKIVRMYSPTSI
LDIRQGPKEPFRDYVDRFYKTLRAEQASQEVKNAATETLLVQNANPDCKT
ILKALGPGATLEEMMTA

In some embodiments, the fusion proteins of the self-assembling protein nanoparticle carrier comprise any of the disclosed heterologous carrier proteins fused to a HIV capsid oligomerization domain including an amino acid sequence at least 80% (such as at least 85%, at least 90%, at least 95%, or at least 97%) identical to the amino acid sequence set forth as any one of SEQ ID NOs: 39-40.

j. Hexamer

In some embodiments, any of the disclosed heterologous carrier proteins (such as an rTT, CRM197, or HiD carrier protein) can be linked to a Hexamer subunit to construct a hexamer nanoparticle carrier including a nanoparticle based on the hexamer sequence fused to a plurality of the heterologous carrier proteins. A non-limiting examples of a hexamer sequence that can be included in the fusion proteins of the self-assembling protein nanoparticle carrier is provided as:

(SEQ ID NO: 41)
PTLYNVSLVMSDTAGTCY

In some embodiments, the fusion proteins of the self-assembling protein nanoparticle carrier comprise any of the disclosed heterologous carrier proteins fused to a hexamer subunit including an amino acid sequence at least 80% (such as at least 85%, at least 90%, at least 95%, or at least 97%) identical to the amino acid sequence set forth as SEQ ID NO: 41.

k. T4 Fibritin Foldon Domain (Fd)

In some embodiments, any of the disclosed heterologous carrier proteins (such as an rTT, CRM197, or HiD carrier protein) can be linked to a T4 fibritin Foldon domain to construct a hexamer nanoparticle carrier including a nanoparticle based on the T4 fibritin Foldon domain sequence fused to a plurality of the heterologous carrier proteins. A non-limiting examples of a T4 fibritin Foldon domain sequence that can be included in the fusion proteins of the self-assembling protein nanoparticle carrier is provided as:

(SEQ ID NO: 42)
GYIPEAPRDGQAYVRKDGEWVLLSTFL

In some embodiments, the fusion proteins of the self-assembling protein nanoparticle carrier comprise any of the disclosed heterologous carrier proteins fused to a T4 fibritin Foldon domain including an amino acid sequence at least 80% (such as at least 85%, at least 90%, at least 95%, or at least 97%) identical to the amino acid sequence set forth as SEQ ID NO: 42.

l. Encapsulin

In some embodiments, any of the disclosed heterologous carrier proteins (such as an rTT, CRM197, or HiD carrier protein) can be linked to an encapsulin subunit to construct a self-assembling encapsulin nanoparticle carrier including an encapsulin nanoparticle fused to a plurality of the heterologous carrier proteins. Encapsulin nanoparticles are formed from 60 copies of the encapsulin subunit.

The globular form of the encapsulin nanoparticle is made up of monomeric subunits. A non-limiting example of the sequence of an encapsulin subunit is provided as:

(SEQ ID NO: 43)
MEFLKRSFAPLTEKQWQEIDNRAREIFKTQLYGRKFVDVEGPYGWEYAAH
PLGEVEVLSDENEVVKWGLRKSLPLIELRATFTLDLWELDNLERGKPNVD
LSSLEETVRKVAEFEDEVIFRGCEKSGVKGLLSFEERKIECGSTPKDLLE
AIVRALSIFSKDGIEGPYTLVINTDRWINFLKEEAGHYPLEKRVEECLRG
GKIITTPRIEDALVVSERGGDFKLILGQDLSIGYEDREKDAVRLFITETF
TFQVVNPEALILLKF

Additional encapsulin subunits are provided with one or more cysteine substitutions to introduce non-native disulfide bond(s) that stabilize the encapsulin nanoparticle formed from self-assembled subunits. In some embodiments, the non-native disulfide bond(s) are introduced with G53C-R94C, G53C-K96C, or K146C-A185C substitutions, or a combination thereof. The residues numbering is with reference to the encapsulin subunit set forth as SEQ ID NO: 43. Non-limiting examples include:

EN G53C-R94C
(SEQ ID NO: 313)
MEFLKRSFAPLTEKQWQEIDNRAREIFKTQLYGRKFVDVEGPYGWEYAAH

PLCEVEVLSDENEVVKWGLRKSLPLIELRATFTLDLWELDNLECGKPNVD

LSSLEETVRKVAEFEDEVIFRGCEKSGVKGLLSFEERKIECGSTPKDLLE

AIVRALSIFSKDGIEGPYTLVINTDRWINFLKEEAGHYPLEKRVEECLRG

GKIITTPRIEDALVVSERGGDFKLILGQDLSIGYEDREKDAVRLFITETF

TFQVVNPEALILLKF

EN G53C-K96C
(SEQ ID NO: 314)
MEFLKRSFAPLTEKQWQEIDNRAREIFKTQLYGRKFVDVEGPYGWEYAAH

PLCEVEVLSDENEVVKWGLRKSLPLIELRATFTLDLWELDNLErGcPNVD

LSSLEETVRKVAEFEDEVIFRGCEKSGVKGLLSFEERKIECGSTPKDLLE

AIVRALSIFSKDGIEGPYTLVINTDRWINFLKEEAGHYPLEKRVEECLRG

GKIITTPRIEDALVVSERGGDFKLILGQDLSIGYEDREKDAVRLFITETF

TFQVVNPEALILLKF

EN K146C-A185C
(SEQ ID NO: 315)
MEFLKRSFAPLTEKQWQEIDNRAREIFKTQLYGRKFVDVEGPYGWEYAAH

PLgEVEVLSDENEVVKWGLRKSLPLIELRATFTLDLWELDNLErGkPNVD

LSSLEETVRKVAEFEDEVIFRGCEKSGVKGLLSFEERKIECGSTPcDLLE

AIVRALSIFSKDGIEGPYTLVINTDRWINFLKEEcGHYPLEKRVEECLRG

GKIITTPRIEDALVVSERGGDFKLILGQDLSIGYEDREKDAVRLFITETF

TFQVVNPEALILLKF

In some embodiments, the fusion proteins of the self-assembling protein nanoparticle carrier comprise any of the disclosed heterologous carrier proteins fused to an encapsulin subunit including an amino acid sequence at least 80% (such as at least 85%, at least 90%, at least 95%, or at least 97%) identical to amino acid sequence set forth as SEQ ID NO: 43 or 313-315.

Encapsulin proteins are a conserved family of bacterial proteins also known as linocin-like proteins that form large protein assemblies that function as a minimal compartment to package enzymes. The encapsulin assembly is made up of monomeric subunits, which are polypeptides having a molecule weight of approximately 30 kDa. Following production, the monomeric subunits self-assemble into the globular encapsulin assembly including 60, or in some cases, 180 monomeric subunits. Methods of constructing encapsulin nanoparticles are described, for example, in Sutter et al. (Nature Struct. and Mol. Biol., 15:939-947, 2008, which is incorporated by reference herein in its entirety). In specific examples, the encapsulin polypeptide is bacterial encapsulin, such as *Thermotoga* maritime or *Pyrococcus furiosus* or *Rhodococcus erythropolis* or *Myxococcus xanthus* encapsulin.

m. *Acinetobacter* Phage AP205 (AP205)

In some embodiments, any of the disclosed heterologous carrier proteins (such as an rTT, CRM197, or HiD carrier protein) can be linked to a *Acinetobacter* phage AP205 domain to construct a self-assembling nanoparticle carrier including a nanoparticle based on the *Acinetobacter* phage AP205 domain sequence fused to a plurality of the heterologous carrier proteins. A non-limiting examples of an *Acinetobacter* phage AP205 domain sequence that can be included in the fusion proteins of the self-assembling protein nanoparticle carrier is provided as:

AP205
(SEQ ID NO: 316)
MANKPMQPITSTANKIVWSDPTRLSTTFSASLLRQRVKVGIAELNNVSGQY

VSVYKRPAPKPEGCADACVIMPNENQSIRTVISGSAENLATLKAEWETHKR

NVDTLFASGNAGLGFLDPTAAIVSSDTT

Additional *Acinetobacter* phage AP205 subunits are provided with one or more cysteine substitutions to introduce non-native disulfide bond(s) that stabilize the *Acinetobacter* phage AP205nanoparticle formed from self-assembled subunits. In some embodiments, the non-native disulfide bond(s) are introduced with T81C (which forms a disulfide with a cysteine already present in AP205), S53C-H100C, or V82C-R80C substitutions, or a combination thereof. The residues numbering is with reference to the *Acinetobacter* phage AP205 subunit set forth as SEQ ID NO: 316. Non-limiting examples include:

AP205-T81C
(SEQ ID NO: 317)
MANKPMQPITSTANKIVWSDPTRLSTTFSASLLRQRVKVGIAELNNVSGQY

VSVYKRPAPKPEGCADACVIMPNENQSIRcVISGSAENLATLKAEWETHKR

NVDTLFASGNAGLGFLDPTAAIVSSDTT

AP205 S53C-H100C
(SEQ ID NO: 318)
MANKPMQPITSTANKIVWSDPTRLSTTFSASLLRQRVKVGIAELNNVSGQY

VcVYKRPAPKPEGCADACVIMPNENQSIRTVISGSAENLATLKAEWET$KR

NVDTLFASGNAGLGFLDPTAAIVSSDTT

AP205 V82C-R80C
(SEQ ID NO: 319)
MANKPMQPITSTANKIVWSDPTRLSTTFSASLLRQRVKVGIAELNNVSGQY

VSVYKRPAPKPEGCADACVIMPNENQSIctcISGSAENLATLKAEWETHKR

NVDTLFASGNAGLGFLDPTAAIVSSDTT

AP205 C65-C69GC
(SEQ ID NO: 320)
MANKPMQPITSTANKIVWSDPTRLSTTFSASLLRQRVKVGIAELNNVSGQY

VSVYKRPAPKPEGCADAgCVIMPNENQSIRTVISGSAENLATLKAEWETHK

RNVDTLFASGNAGLGFLDPTAAIVSSDTT

In some embodiments, the fusion proteins of the self-assembling protein nanoparticle carrier comprise any of the disclosed heterologous carrier proteins fused to a *Acinetobacter* phage AP205 subunit including an amino acid sequence at least 80% (such as at least 85%, at least 90%, at least 95%, or at least 97%) identical to the amino acid sequence set forth as SEQ ID NO: 316-320.

n. Hepatitis B Capsid Protein (HBV)

In some embodiments, any of the disclosed heterologous carrier proteins (such as an rTT, CRM197, or HiD carrier protein) can be linked to a Hepatitis B capsid protein domain to construct a self-assembling nanoparticle carrier including a nanoparticle based on the Hepatitis B capsid protein domain sequence fused to a plurality of the heterologous carrier proteins. A non-limiting examples of an Hepatitis B capsid protein domain sequence that can be included in the fusion proteins of the self-assembling protein nanoparticle carrier is provided as:

HBV
(SEQ ID NO: 321)
MDIDPYKEFGATVELLSFLPSDFFPSVRDLLDTASALYREALESPEHCSPH

HTALRQAILCWGELMTLATWVGVNLEDPASRDLVVSYVNTNMGLKFRQLLW

FHISCLTFGRETVIEYLVSFGVWIRTPPAYRPPNAPILSTLPETTVVRRRG

RSPRRRTPSPRRRRSQSPRRRRSQSRESQC

Additional Hepatitis B capsid protein subunits are provided with one or more cysteine substitutions to introduce non-native disulfide bond(s) that stabilize the Hepatitis B capsid protein domain nanoparticle formed from self-assembled subunits. In some embodiments, the non-native disulfide bond(s) are introduced with P25C-R127C, E14C-A36C, D29C-R127C, F18C-A36C, or D29C-R127C substitutions, or a combination thereof. The residues numbering is with reference to the Hepatitis B capsid protein subunit set forth as SEQ ID NO: 321. Non-limiting examples include:

HBV P25C-R127C
(SEQ ID NO: 322)
MDIDPYKEFGATVELLSFLPSDFFcSVRDLLDTASALYREALESPEHCSPH

HTALRQAILCWGELMTLATWVGVNLEDPASRDLVVSYVNTNMGLKFRQLLW

FHISCLTFGRETVIEYLVSFGVWIcTPPAYRPPNAPILSTLPETTVVRRRG

RSPRRRTPSPRRRRSQSPRRRRSQSRESQC

HBV E14C-A36C
(SEQ ID NO: 323)
MDIDPYKEFGATVcLLSFLPSDFFPSVRDLLDTAScLYREALESPEHCSPH

HTALRQAILCWGELMTLATWVGVNLEDPASRDLVVSYVNTNMGLKFRQLLW

FHISCLTFGRETVIEYLVSFGVWIRTPPAYRPPNAPILSTLPETTVVRRRG

RSPRRRTPSPRRRRSQSPRRRRSQSRESQC

HBV D29C-R127C
(SEQ ID NO: 324)
MDIDPYKEFGATVELLSFLPSDFFPSVRcLLDTASALYREALESPEHCSPH

HTALRQAILCWGELMTLATWVGVNLEDPASRDLVVSYVNTNMGLKFRQLLW

FHISCLTFGRETVIEYLVSFGVWIcTPPAYRPPNAPILSTLPETTVVRRRG

RSPRRRTPSPRRRRSQSPRRRRSQSRESQC

HBV_DS01 (F18C-A36C)
(SEQ ID NO: 325)
MDIDPYKEFGATVELLSCLPSDFFPSVRDLLDTASCLYREALESPEHCSPH

HTALRQAILCWGELMTLATWVGVNLEDPASRDLVVSYVNTNMGLKFRQLLW

FHISCLTFGRETVIEYLVSFGVWIRTPPAYRPPNAPILSTLPETTVVRRRG

RSPRRRTPSPRRRRSQSPRRRRSQSRESQC

-continued

HBV_DS02 (D29C-R127C)
(SEQ ID NO: 326)
MDIDPYKEFGATVELLSFLPSDFFPSVRCLLDTASALYREALESPEHCSPH

HTALRQAILCWGELMTLATWVGVNLEDPASRDLVVSYVNTNMGLKFRQLLW

FHISCLTFGRETVIEYLVSFGVWICTPPAYRPPNAPILSTLPETTVVRRRG

RSPRRRTPSPRRRRSQSPRRRRSQSRESQC

In some embodiments, the fusion proteins of the self-assembling protein nanoparticle carrier comprise any of the disclosed heterologous carrier proteins fused to a Hepatitis B capsid subunit including an amino acid sequence at least 80% (such as at least 85%, at least 90%, at least 95%, or at least 97%) identical to the amino acid sequence set forth as any one of SEQ ID NO: 321-326.

2. Heterologous Carrier Proteins

The heterologous carrier protein included in the fusion protein can be any carrier protein suitable for use as with a vaccine that is a single polypeptide chain of amino acids (as opposed to a protein complex). Examples of suitable heterologous carrier proteins are those that can increase the immunogenicity of the conjugate and/or elicit antibodies against the carrier which are diagnostically, analytically, and/or therapeutically beneficial. Specific, non-limiting examples of suitable polypeptide carriers include, but are not limited to, natural, semi-synthetic or synthetic polypeptides or proteins from bacteria or viruses. In one embodiment, bacterial products for use as carriers include bacterial toxins, such as those that are single polypeptide chains (or a fragment thereof) that mediate toxic effects, inflammatory responses, stress, shock, chronic sequelae, or mortality in a susceptible host. Specific, non-limiting examples of such bacterial toxins include, but are not limited to: single polypeptide chains of *B. anthracis* PA (for example, as encoded by bases 143779 to 146073 of GENBANK® Accession No. NC 007322); *B. anthracis* LF (for example, as encoded by the complement of bases 149357 to 151786 of GENBANK® Accession No. NC 007322); bacterial toxins and toxoids, such as tetanus toxin/toxoid (for example, as described in U.S. Pat. Nos. 5,601,826 and 6,696,065); diphtheria toxin/toxoid (for example, as described in U.S. Pat. Nos. 4,709,017 and 6,696,065), such as tetanus toxin heavy chain C fragment; *P. aeruginosa* exotoxin/toxoid (for example, as described in U.S. Pat. Nos. 4,428,931, 4,488, 991 and 5,602,095); pertussis toxin/toxoid (for example, as described in U.S. Pat. Nos. 4,997,915, 6,399,076 and 6,696, 065); and *C. perfringens* exotoxin/toxoid (for example, as described in U.S. Pat. Nos. 5,817,317 and 6,403,094) *C. difficile* toxin B or A, or analogs or mimetics of and combinations of two or more thereof. Viral proteins, such as hepatitis B surface antigen (for example, as described in U.S. Pat. Nos. 5,151,023 and 6,013,264) and core antigen (for example, as described in U.S. Pat. Nos. 4,547,367 and 4,547,368) can also be used as carriers, as well as single polypeptide chains of proteins from higher organisms such as keyhole limpet hemocyanin (KLH), horseshoe crab hemocyanin, Concholepas Concholepas Hemocyanin (CCH), Ovalbumin (OVA), edestin, mammalian serum albumins (such as bovine serum albumin), and mammalian immunoglobulins.

In some embodiments, the heterologous carrier protein is selected from one of: a Keyhole Limpet Hemocyanin (KLH) subunit, recombinant tetanus toxin heavy chain C fragment (rTT), diphtheria toxin variant CRM197, or *H. influenzae* protein D (HiD). CRM197 is a genetically detoxified form of diphtheria toxin; a single mutation at position 52, substituting glutamic acid for glycine, causes the ADP-ribosyltransferase activity of the native diphtheria toxin to be lost. For description of exemplary protein carriers for vaccines, see Pichichero, Protein carriers of conjugate vaccines: characteristics, development, and clinical trials, Hum Vaccin Immunother., 9: 2505-2523, 2013, which is incorporated by reference herein in its entirety).

In some embodiments, the heterologous carrier protein is an rTT protein, for example, comprising the amino acid sequence set forth as:

(SEQ ID NO: 44)
MKNLDCWVDNEEDIDVILKKSTILNLDINNDIISDISGFNSSVITYPDAQL

VPGINGKAIHLVNNESSEVIVHKAMDIEYNDMFNNFTVSFWLRVPKVSASH

LEQYGTNEYSIISSMKKHSLSIGSGWSVSLKGNNLIWTLKDSAGEVRQITF

RDLPDKFNAYLANKWVFITITNDRLSSANLYINGVLMGSAEITGLGAIRED

NNITLKLDRCNNNNQYVSIDKFRIFCKALNPKEIEKLYTSYLSITFLRDFW

GNPLRYDTEYYLIPVASSSKDVQLKNITDYMYLTNAPSYTNGKLNIYYRRL

YNGLKFIIKRYTPNNEIDSFVKSGDFIKLYVSYNNNEHIVGYPKDGNAFNN

LDRILRVGYNAPGIPLYKKMEAVKLRDLKTYSVQLKLYDDKNASLGLVGTH

NGQIGNDPNRDILIASNWYFNHLKDKILGCDWYFVPTDEGWTND

In some embodiments, the heterologous carrier protein is an rTT protein comprising amino acid substitutions to remove one or more N-linked glycosylation sites. It is believed that removal of the N-linked glycosylation sites may improve accessibility of the protein surface for conjugation to the HIV-1 Env fusion peptide. Exemplary rTT protein sequences with modifications to remove one or more N-linked glycosylation sites are provided as:

(SEQ ID NO: 45)
NLDCWVDNEEDIDVILKKSTILNLDINNDIISDISGFNS<u>A</u>VITYPDAQLVP

GINGKAIHLVNNE<u>A</u>SEVIVHKAMDIEYNDMFN<u>Q</u>FTVSFWLRVPKVSASHLE

QYGTNEYSIISSMKKHSLSIGSGWSVSLKGNNLIWTLKDSAGEVRQITFRD

LPDKFNAYLANKWVFITITNDRLSSANLYINGVLMGSAEITGLGAIREDN<u>Q</u>

ITLKLDRCNNNNQYVSIDKFRIFCKALNPKEIEKLYTSYLSITFLRDFWGN

PLRYDTEYYLIPVASSSKDVQLK<u>Q</u>ITDYMYLTNAPSYTNGKLNIYYRRLYN

GLKFIIKRYTPNNEIDSFVKSGDFIKLYVSYNNNEHIVGYPKDGNAFNNLD

RILRVGYNAPGIPLYKKMEAVKLRDLKTYSVQLKLYDDKNASLGLVGTHNG

QIGNDPNRDILIASNWYFNHLKDKILGCDWYFVPTDEGWTND (SEQ ID NO: 46)
NLDCWVDNEEDIDVILKKSTILNLDINNDIISDISGFNSAVITYPDAQLVP

GINGKAIHLVNNEASEVIVHKAMDIEYNDMFNNFTVSFWLRVPKVSASHLE

QYGTNEYSIISSMKKHSLSIGSGWSVSLKGNNLIWTLKDSAGEVRQITFRD

LPDKFNAYLANKWVFITITNDRLSSANLYINGVLMGSAEITGLGAIREDNQ

ITLKLDRCNNNNQYVSIDKFRIFCKALNPKEIEKLYTSYLSITFLRDFWGN

PLRYDTEYYLIPVASSSKDVQLKQITDYMYLTNAPSYTNGKLNIYYRRLYN

GLKFIIKRYTPNNEIDSFVKSGDFIKLYVSYNNNEHIVGYPKDGNAFNNLD

RILRVGYNAPGIPLYKKMEAVKLRDLKTYSVQLKLYDDKQASLGLVGTHNG

QIGNDPNRDILIASNWYFNHLKDKILGCDWYFVPTDEGWTND

In some embodiments, the heterologous carrier protein is an rTT protein comprising amino acid substitutions to remove one or more N-linked glycosylation sites as well as to introduce lysine residues at surface exposed positions of the carrier. Increasing the number of lysine residues in the heterologous carrier protein increases the number of available sites for conjugation to the HIV-1 Env fusion peptides with methods targeting the amino moiety of lysine, such as sulfosuccinimidyl (4-iodoacetyl)aminobenzoate (Sulfo-SIAB) linkers. Exemplary rTT protein sequences with modifications to remove one or more N-linked glycosylation sites and/or to add lysine residues are provided as:

(SEQ ID NO: 47)
NLDCWVDkEEDIDVILKKSTILNLDINkDIISDISkFNSAVITYPDAQLVP

GINGKAIHLVNNEkSEVIVHKAMkIEYNDMFNNFTVSFWLRVPKVSASHLE

QYGTNEYSIISSMKKHSLSIGSGWSVSLKGNNLIWTLKDSAGEVRQITFRD

LPDKFNAYLANKWVFITITNDRLSSANLYINGVLMGSAEITGLGAIREDNQ

ITLKLDRCNNNNQYVSIDKFRIFCKALNPKEIEKLYTSYLSITFLRDFWGN

PLRYDTEYYLIPVASSSKDVQLKQITDYMYLTNAPSYTNGKLNIYYRRLYN

GLKFIIKRYTPNNEIDSFVKSGDFIKLYVSYNNNEHIVGYPKDGNAFNNLD

RILRVGYNAPGIPLYKKMEAVKLRDLKTYSVQLKLYDDKQASLGLVGTHNG

QIGNDPNRDILIASNWYFNHLKDKILGCDWYFVPTDEGWTND (SEQ ID NO: 48)
NLDCWVDNEEDIDVILKKSTILNLDINNDIISDISGFNSSVITYPDAQLVP

GINGKAIHLVNNESSEVIVHKAMDIEYNDMFNNFTVSFWLRVPKVSASHLE

QYGTNEYSIISSMKKHSLSIGSGWSVSLKGNNLIWTLKDSAGEVRQITFRD

LPDKFNAYLANKWVFITITNDRLSSANLYINGVLMGSAEITGLGAIREDNN

ITLKLDRCNNNNQYVSIDKFRIFCKALNPKEIEKLYTSYLSITFLRDFWGN

PLRYDTEYYLIPVASSSKDVQLKNITDYMYLTNAPSYTNGKLNIYYRRLYN

GLKFIIKRYTPNNEIDSFVKSGDFIKLYVSYNNNEHIVGYPKDGNAFNNLD

RILRVGYNAPGIPLYKKMEAVKLRDLKTYSVQLKLYDDKNASLGLVGTHNG

QIGNDPNRDILIASNWYFNHLKDKILGCDWYFVPTDEGWTND (SEQ ID NO: 49)
NLDCWVDNEEDIDVILKKSTILNLDINNDIISDISGFNSAVITYPDAQLVP

GINGKAIHLVNNEASEVIVHKAMDIEYNDMFNQFTVSFWLRVPKVSASHLE

QYGTNEYSIISSMKKHSLSIGSGWSVSLKGNNLIWTLKDSAGEVRQITFRD

LPDKFNAYLANKWVFITITNDRLSSANLYINGVLMGSAEITGLGAIREDNQ

ITLKLDRCNNNNQYVSIDKFRIFCKALNPKEIEKLYTSYLSITFLRDFWGN

PLRYDTEYYLIPVASSSKDVQLKQITDYMYLTNAPSYTNGKLNIYYRRLYN

GLKFIIKRYTPNNEIDSFVKSGDFIKLYVSYNNNEHIVGYPKDGNAFNNLD

RILRVGYNAPGIPLYKKMEAVKLRDLKTYSVQLKLYDDKNASLGLVGTHNG

QIGNDPNRDILIASNWYFNHLKDKILGCDWYFVPTDEGWTND (SEQ ID NO: 50)
NLDCWVDNEEDIDVILKKSTILNLDINNDIISDISGFNSAVITYPDAQLVP
GINGKAIHLVNNEASEVIVHKAMDIEYNDMFNNFTVSFWLRVPKVSASHLE
QYGTNEYSIISSMKKHSLSIGSGWSVSLKGNNLIWTLKDSAGEVRQITFRD
LPDKFNAYLANKWVFITITNDRLSSANLYINGVLMGSAEITGLGAIREDNQ
ITLKLDRCNNNQYVSIDKFRIFCKALNPKEIEKLYTSYLSITFLRDFWGN
PLRYDTEYYLIPVASSSKDVQLKQITDYMYLTNAPSYTNGKLNIYYRRLYN
GLKFIIKRYTPNNEIDSFVKSGDFIKLYVSYNNNEHIVGYPKDGNAFNNLD
RILRVGYNAPGIPLYKKMEAVKLRDLKTYSVQLKLYDDKQASLGLVGTHNG
QIGNDPNRDILIASNWYFNHLKDKILGCDWYFVPTDEGWTND (SEQ ID NO: 51)
NLDCWVDNEEDIDVILKKSTILNLDINNDIISDISGFNSAVITYPDAQLVP
GINGKAIHLVNNEASEVIVHKAMDIEYNDMFNNFTVSFWLRVPKVSASHLE
QYGTNEYSIISSMKKHSLSIGSGWSVSLKGNNLIWTLKDSAGEVRQITFRD
LPDKFNAYLANKWVFITITNDRLSSANLYINGVLMGSAEITGLGAIREDNQ
ITLKLDRCNNNQYVSIDKFRIFCKALNPKEIEKLYTSYLSITFLRDFWGN
PLRYDTEYYLIPVASSSKDVQLKQITDYMYLTNAPSYTNGKLNIYYRRLYN
GLKFIIKRYTPNNEIDSFVKSGDFIKLYVSYNNNEHIVGYPKDGNAFNNLD
RILRVGYNAPGIPLYKKMEAVKLRDLKTYSVQLKLYDDKQASLGLVGTHNG
QIGNDPNRDILIASNWYFNHLKDKILGCDWYFVPTDEGWTND (SEQ ID NO: 52)
NLDCWVDNEEDIDVILKKSTILNLDINNDIISDISGFNSAVITYPDAQLVP
GINGKAIHLVNNEASEVIVHKAMDIEYNDMFNNFTVSFWLRVPKVSASHLE
QYGTNEYSIISSMKKHSLSIGSGWSVSLKGNNLIWTLKDSAGEVRQITFRD
LPDKFNAYLANKWVFITITNDRLSSANLYINGVLMGSAEITGLGAIREDNQ
ITLKLDRCNNNQYVSIDKFRIFCKALNPKEIEKLYTSYLSITFLRDFWGN
PLRYDTEYYLIPVASSSKDVQLKQITDYMYLTNAPSYTNGKLNIYYRRLYN
GLKFIIKRYTPNNEIDSFVKSGDFIKLYVSYkNNEHIVGYPKDGNAFNkLD
RILRVGYkAPkIPLYKKMEAVKLRDLKTYSVQLKLYDDKQASLGLVGTHNG
QIGkDPNRDILIASNWYFNHLKDKILGCDWYFVPTDEGWTND (SEQ ID NO: 53)
NLDCWVDkEEDIDVILKKSTILNLDINkDIISDISkFNSAVITYPDAQLVP
GINGKAIHLVNNEkSEVIVHKAMkIEYNDMFNNFTVSFWLRVPKVSASHLE
QYGTNEYSIISSMKKHSLSIGSGWSVSLKGNNLIWTLKDSAGEVRQITFRD
LPDKFNAYLANKWVFITITNDRLSSANLYINGVLMGSAEITGLGAIREDNQ
ITLKLDRCNNNQYVSIDKFRIFCKALNPKEIEKLYTSYLSITFLRDFWGN
PLRYDTEYYLIPVASSSKDVQLKQITDYMYLTNAPSYTNGKLNIYYRRLYN
GLKFIIKRYTPNNEIDSFVKSGDFIKLYVSYNNNEHIVGYPKDGNAFNNLD
RILRVGYNAPGIPLYKKMEAVKLRDLKTYSVQLKLYDDKQASLGLVGTHNG
QIGNDPNRDILIASNWYFNHLKDKILGCDWYFVPTDEGWTND (SEQ ID NO: 54)
NLDCWVDNEEDIDVILKKSTILNLDINNDIISDISGFNSAVITYPDAQLVP
GINGKAIHLVNNEASEVIVHKAMDIEYNDMFNNFTVSFWLRVPKVSASHLE
QYGTNEYSIISSMKKHkkSIGSGWSVSLKGNNLIWTLKDSkGEVRQITFRD
LPkKFNAYLANKWVFITITNDRkSSANLYINGVLMGSAEITGLGAIREDNQ
ITLKLDRCNNNQYVSIDKFRIFCKALNPKEIEKLYTSYLSITFLRDFWGN
PLRYDTEYYLIPVASSSKDVQLKQITDYMYLTNAPSYTNGKLNIYYRRLYN
GLKFIIKRYTPNNEIDSFVKSGDFIKLYVSYNNNEHIVGYPKDGNAFNNLD
RILRVGYNAPGIPLYKKMEAVKLRDLKTYSVQLKLYDDKQASLGLVGTHNG
QIGNDPNRDILIASNWYFNHLKDKILGCDWYFVPTDEGWTND (SEQ ID NO: 55)
NLDCWVDNEEDIDVILKKSTILNLDINNDIISDISGFNSAVITYPDAQLVP
GINGKAIHLVNNEASEVIVHKAMDIEYNDMFNNFTVSFWLRVPKVSASHLE
QYGTNEYSIISSMKKHSLSIGSGWSVSLKGNNLIWTLKDSAGEVRQITFRD
LPDKFNAYLANKWVFITITNDRLSSANLYINGVLMGSAEITkLGAIREDNQ
ITLKLDRCkNNNQYVSIDKFRIFCKALNPKEIEKLYTSYLSITFLRDFWGN
PLRYDTEYYLIPVASSSKDVQLKQITDYMYLTkAPSYTNGKLNIYYRRLYN
GLKFIIKRYkPNNkIDSFVKSGDFIKLYVSYNNNEHIVGYPKDGNAFNNLD
RILRVGYNAPGIPLYKKMEAVKLRDLKTYSVQLKLYDDKQASLGLVGTHNG
QIGNDPNRDILIASNWYFNHLKDKILGCDWYFVPTDEGWTND (SEQ ID NO: 56)
NLDCWVDkEEDIDVILKKSTILNLDINkDIISDISkFNSAVITYPDAQLVP
GINGKAIHLVNNEkSEVIVHKAMkIEYNDMFNNFTVSFWLRVPKVSASHLE
QYGTNEYSIISSMKKHkkSIGSGWSVSLKGNNLIWTLKDSkGEVRQITFRD
LPkKFNAYLANKWVFITITNDRkSSANLYINGVLMGSAEITGLGAIREDNQ
ITLKLDRCNNNQYVSIDKFRIFCKALNPKEIEKLYTSYLSITFLRDFWGN
PLRYDTEYYLIPVASSSKDVQLKQITDYMYLTNAPSYTNGKLNIYYRRLYN
GLKFIIKRYTPNNEIDSFVKSGDFIKLYVSYNNNEHIVGYPKDGNAFNNLD
RILRVGYNAPGIPLYKKMEAVKLRDLKTYSVQLKLYDDKQASLGLVGTHNG
QIGNDPNRDILIASNWYFNHLKDKILGCDWYFVPTDEGWTND (SEQ ID NO: 57)
NLDCWVDNEEDIDVILKKSTILNLDINNDIISDISGFNSAVITYPDAQLVP
GINGKAIHLVNNEASEVIVHKAMDIEYNDMFNNFTVSFWLRVPKVSASHLE
QYGTNEYSIISSMKKHSLSIGSGWSVSLKGNNLIWTLKDSAGEVRQITFRD
LPDKFNAYLANKWVFITITNDRLSSANLYINGVLMGSAEITkLGAIREDNQ
ITLKLDRCkNNNQYVSIDKFRIFCKALNPKEIEKLYTSYLSITFLRDFWGN
PLRYDTEYYLIPVASSSKDVQLKQITDYMYLTkAPSYTNGKLNIYYRRLYN
GLKFIIKRYkPNNkIDSFVKSGDFIKLYVSYkNNEHIVGYPKDGNAFNkLD
RILRVGYkAPkIPLYKKMEAVKLRDLKTYSVQLKLYDDKQASLGLVGTHNG
QIGkDPNRDILIASNWYFNHLKDKILGCDWYFVPTDEGWTND (SEQ ID NO: 58)
NLDCWVDkEEDIDVILKKSTILNLDINkDIISDISkFNSAVITYPDAQLVP
GINGKAIHLVNNEkSEVIVHKAMkIEYNDMFNNFTVSFWLRVPKVSASHLE
QYGTNEYSIISSMKKHSLSIGSGWSVSLKGNNLIWTLKDSAGEVRQITFRD
LPDKFNAYLANKWVFITITNDRLSSANLYINGVLMGSAEITkLGAIREDNQ
ITLKLDRCkNNNQYVSIDKFRIFCKALNPKEIEKLYTSYLSITFLRDFWGN

-continued

PLRYDTEYYLIPVASSSKDVQLKQITDYMYLTkAPSYTNGKLNIYYRRLYN
GLKFIIKRYkPNNkIDSFVKSGDFIKLYVSYNNNEHIVGYPKDGNAFNNLD
RILRVGYNAPGIPLYKKMEAVKLRDLKTYSVQLKLYDDKQASLGLVGTHNG
QIGNDPNRDILIASNWYFNHLKDKILGCDWYFVPTDEGWTND (SEQ ID NO: 59)
NLDCWVDNEEDIDVILKKSTILNLDINNDIISDISGFNSAVITYPDAQLVP
GINGKAIHLVNNEASEVIVHKAMDIEYNDMFNNFTVSFWLRVPKVSASHLE
QYGTNEYSIISSMKKHkkSIGSGWSVSLKGNNLIWTLKDSkGEVRQITFRD
LPkKFNAYLANKWVFITITNDRkSSANLYINGVLMGSAEITGLGAIREDNQ
ITLKLDRCNNNNQYVSIDKFRIFCKALNPKEIEKLYTSYLSITFLRDFWGN
PLRYDTEYYLIPVASSSKDVQLKQITDYMYLTNAPSYTNGKLNIYYRRLYN
GLKFIIKRYTPNNEIDSFVKSGDFIKLYVSYkNNEHIVGYPKDGNAFNkLD
RILRVGYkAPkIPLYKKMEAVKLRDLKTYSVQLKLYDDKQASLGLVGTHNG
QIGkDPNRDILIASNWYFNHLKDKILGCDWYFVPTDEGWTND (SEQ ID NO: 60)
NLDCWVDkEEDIDVILKKSTILNLDINkDIISDISkFNSAVITYPDAQLVP
GINGKAIHLVNNEkSEVIVHKAMkIEYNDMFNNFTVSFWLRVPKVSASHLE
QYGTNEYSIISSMKKHkkSIGSGWSVSLKGNNLIWTLKDSkGEVRQITFRD
LPkKFNAYLANKWVFITITNDRkSSANLYINGVLMGSAEITkLGAIREDNQ
ITLKLDRCkNNNNQYVSIDKFRIFCKALNPKEIEKLYTSYLSITFLRDFWGN
PLRYDTEYYLIPVASSSKDVQLKQITDYMYLTkAPSYTNGKLNIYYRRLYN
GLKFIIKRYkPNNkIDSFVKSGDFIKLYVSYNNNEHIVGYPKDGNAFNNLD
RILRVGYNAPGIPLYKKMEAVKLRDLKTYSVQLKLYDDKQASLGLVGTHNG
QIGNDPNRDILIASNWYFNHLKDKILGCDWYFVPTDEGWTND (SEQ ID NO: 61)
NLDCWVDNEEDIDVILKKSTILNLDINNDIISDISGFNSAVITYPDAQLVP
GINGKAIHLVNNEASEVIVHKAMDIEYNDMFNNFTVSFWLRVPKVSASHLE
QYGTNEYSIISSMKKHkkSIGSGWSVSLKGNNLIWTLKDSkGEVRQITFRD
LPkKFNAYLANKWVFITITNDRkSSANLYINGVLMGSAEITkLGAIREDNQ
ITLKLDRCkNNNNQYVSIDKFRIFCKALNPKEIEKLYTSYLSITFLRDFWGN
PLRYDTEYYLIPVASSSKDVQLKQITDYMYLTkAPSYTNGKLNIYYRRLYN
GLKFIIKRYkPNNkIDSFVKSGDFIKLYVSYkNNEHIVGYPKDGNAFNkLD
RILRVGYkAPkIPLYKKMEAVKLRDLKTYSVQLKLYDDKQASLGLVGTHNG
QIGkDPNRDILIASNWYFNHLKDKILGCDWYFVPTDEGWTND (SEQ ID NO: 62)
NLDCWVDkEEDIDVILKKSTILNLDINkDIISDISkFNSAVITYPDAQLVP
GINGKAIHLVNNEkSEVIVHKAMkIEYNDMFNNFTVSFWLRVPKVSASHLE
QYGTNEYSIISSMKKHSLSIGSGWSVSLKGNNLIWTLKDSAGEVRQITFRD
LPDKFNAYLANKWVFITITNDRLSSANLYINGVLMGSAEITkLGAIREDNQ
ITLKLDRCkNNNNQYVSIDKFRIFCKALNPKEIEKLYTSYLSITFLRDFWGN
PLRYDTEYYLIPVASSSKDVQLKQITDYMYLTkAPSYTNGKLNIYYRRLYN
GLKFIIKRYkPNNkIDSFVKSGDFIKLYVSYkNNEHIVGYPKDGNAFNkLD
RILRVGYkAPkIPLYKKMEAVKLRDLKTYSVQLKLYDDKQASLGLVGTHNG
QIGkDPNRDILIASNWYFNHLKDKILGCDWYFVPTDEGWTND (SEQ ID NO: 63)
NLDCWVDkEEDIDVILKKSTILNLDINkDIISDISkFNSAVITYPDAQLVP
GINGKAIHLVNNEkSEVIVHKAMkIEYNDMFNNFTVSFWLRVPKVSASHLE
QYGTNEYSIISSMKKHkkSIGSGWSVSLKGNNLIWTLKDSkGEVRQITFRD
LPkKFNAYLANKWVFITITNDRkSSANLYINGVLMGSAEITGLGAIREDNQ
ITLKLDRCNNNNQYVSIDKFRIFCKALNPKEIEKLYTSYLSITFLRDFWGN
PLRYDTEYYLIPVASSSKDVQLKQITDYMYLTNAPSYTNGKLNIYYRRLYN
GLKFIIKRYTPNNEIDSFVKSGDFIKLYVSYkNNEHIVGYPKDGNAFNkLD
RILRVGYkAPkIPLYKKMEAVKLRDLKTYSVQLKLYDDKQASLGLVGTHNG
QIGkDPNRDILIASNWYFNHLKDKILGCDWYFVPTDEGWTND

In some embodiments, the heterologous carrier protein is a fragment of the rTT protein, such as a fragment of rTT protein comprising, consisting essentially of, or consisting of the amino acid sequence set forth as:

(SEQ ID NO: 64)
NLDCWVDNEEDIDVILKKSTILNLDINNDIISDISGFNSSVITYPDAQLVP
GINGKAIHLVNNESSEVIVHKAMDIEYNDMFNNFTVSFWLRVPKVSASHLE
QYGTNEYSIISSMKKHSLSIGSGWSVSLKGNNLIWTLKDSAGEVRQITFRD
LPDKFNAYLANKWVFITITNDRLSSANLYINGVLMGSAEITGLGAIREDNN
ITLKLDRCNNNNQYVSIDKFRIFCKALNPKEIEKLYTSYLSIT

In some embodiments, the fusion protein can include an rTT sequence set forth as any one of SEQ ID NOs: 44-64, or an amino acid sequence at least 90% identical thereto.

In some embodiments, the heterologous carrier protein is a HiD protein, for example, comprising the amino acid sequence set forth as:

(SEQ ID NO: 65)
SNMANTQMKSDKIIIAHRGASGYLPEHTLESKALAFAQQADYLEQDLAMTK
DGRLVVIHDHFLDGLTDVAKKFPHRHRKDGRYYVIDFTLKEIQSLEMTENF
ETKDGKQAQVYPNRFPLWKSHFRIHTFEDEIEFIQGLEKSTGKKVGIYPEI
KAPWFHHQNGKDIAAETLKVLKKYGYDKKTDMVYLQTFDFNELKRIKTELL
PQMGMDLKLVQLIAYTDWKETQEKDPKGYWVNYNYDWMFKPGAMAEVVKYA
DGVGPGWYMLVNKEESKPDNIVYTPLVKELAQYNVEVHPYTVRKDALPEFF
TDVNQMYDALLNKSGATGVFTDFPDTGVEFLKGIK

In some embodiments, the fusion protein can include a HiD sequence set forth as SEQ ID NO: 65, or an amino acid sequence at least 90% identical thereto.

In some embodiments, the heterologous carrier protein is a HiD protein comprising amino acid substitutions to remove one or more N-linked glycosylation sites and/or to introduce lysine residues at surface exposed positions of the carrier. It is believed that removal of the N-linked glycosylation sites may improve accessibility of the protein surface for conjugation to the HIV-1 Env fusion peptide.

In some embodiments, the heterologous carrier protein is a CRM197 protein, for example, comprising the amino acid sequence set forth as:

(SEQ ID NO: 66)
GADDVVDSSKSFVMENFSSYHGTKPGYVDSIQKGIQKPKSGTQGNYDDDWK

EFYSTDNKYDAAGYSVDNENPLSGKAGGVVKVTYPGLTKVLALKVDNAETI

KKELGLSLTEPLMEQVGTEEFIKRFGDGASRVVLSLPFAEGSSSVEYINNW

EQAKALSVELEINFETRGKRGQDAMYEYMAQACAGNRVRRSVGSSLSCINL

DWDVIRDKTKTKIESLKEHGPIKNKMSESPNKTVSEEKAKQYLEEFHQTAL

EHPELSELKTVTGTNPVFAGANYAAWAVNVAQVIDSETADNLEKTTAALSI

LPGIGSVMGIADGAVHHNTEEIVAQSIALSSLMVAQAIPLVGELVDIGFAA

YNFVESIINLFQVVHNSYNRPAYSPGHKTQPFLHDGYAVSWNTVEDSIIRT

GFQGESGHDIKITAENTPLPIAGVLLPTIPGKLDVNKSKTHISVNGRKIRM

RCRAIDGDVTFCRPKSPVYVGNGVHANLHVAFHRSSSEKIHSNEISSDSIG

VLGYQKTVDHTKVNSKLSLFFEIKS

In some embodiments, the fusion protein can include a CRM197 sequence set forth as SEQ ID NO: 66, or an amino acid sequence at least 90% identical thereto.

In some embodiments, the heterologous carrier protein is a CRM197 protein comprising amino acid substitutions to remove one or more N-linked glycosylation sites. It is believed that removal of the N-linked glycosylation sites may improve accessibility of the protein surface for conjugation to the HIV-1 Env fusion peptide. An exemplary CRM197 protein sequence with modifications to remove one or more N-linked glycosylation sites is provided as:

(SEQ ID NO: 67)
GADDVVDSSKSFVMENFASYHGTKPGYVDSIQKGIQKPKSGTQGNYDDDWK

EFYSTDNKYDAAGYSVDNENPLSGKAGGVVKVTYPGLTKVLALKVDNAETI

KKELGLSLTEPLMEQVGTEEFIKRFGDGASRVVLSLPFAEGSSSVEYINNW

EQAKALSVELEINFETRGKRGQDAMYEYMAQACAGNRVRRSVGSSLSCINL

DWDVIRDKTKTKIESLKEHGPIKNKMSESPNKAVSEEKAKQYLEEFHQTAL

EHPELSELKTVTGTNPVFAGANYAAWAVNVAQVIDSETADNLEKTTAALSI

LPGIGSVMGIADGAVHHNTEEIVAQSIALSSLMVAQAIPLVGELVDIGFAA

YNFVESIINLFQVVHNSYNRPAYSPGHKTQPFLHDGYAVSWNTVEDSIIRT

GFQGESGHDIKITAENTPLPIAGVLLPTIPGKLDVNKAKTHISVNGRKIRM

RCRAIDGDVTFCRPKSPVYVGNGVHANLHVAFHRSSSEKIHSNEISSDSIG

VLGYQKTVDHTKVNSKLSLFFEIKS

In some embodiments, the fusion protein can include a CRM197 sequence set forth as SEQ ID NOs: 67, or an amino acid sequence at least 90% identical thereto.

In some embodiments, the heterologous carrier protein is a Meningococcal outer membrane protein complex (OMPC) protein. An exemplary OMPC protein sequence with modifications to remove one or more N-linked glycosylation sites is provided as:

(SEQ ID NO: 222)
DFTIQDIRVEGLQRTEPSTVFNYLPVKVGDTYNDTHGSAIIKSLYATGFFD

DVRVETADGQLLLTVIERPTIGSLNITGAKMLQNDAIKKNLESFGLAQSQY

FNQATLNQAVAGLKEEYLGRGKLNIQITPKVTKLARNRVDIDITIDEGKSA

KITDIEFEGNQVYSDRKLMRQMSLTEGGIWTWLTRSNQFNEQKFAQDMEKV

TDFYQNNGYFDFRILDTDIQTNEDKTKQTIKITVHEGERFRWGKVSIEGDT

NEVPKAELEKLLTMKPGKWYERQQMTAVLGEIQNRMGSAGYAYSEISVQPL

PNAETKTVDFVLHIEPGRKIYVNEIHITGNNKTRDEVVRRELRQMESAPYD

TSKLQRSKERVELLGYFDNVQFDAVPLAGTPDKVDLNMSLTERSTGSLDLS

AGWVQDTGLVMSAGVSQDNLFGTGKSAALRASRSKTTLNGSLSFTDPYFTA

DGVSLGYDVYGKAFDPRKASTSIKQYKTTTAGAGIRMSVPVTEYDRVNFGL

VAEHLTVNTYNKAPKHYADFIKKYGKTDGTDGSFKGWLYKGTVGWGRNKTD

SALWPTRGYLTGVNAEIALPGSKLQYYSATHNQTWFFPLSKTFTLMFGGEV

GIAGGYGKTKEIPFFENFYGGGLGSVRGYESGTLGPKVYDEYGEKISYGGN

KKANVSAELLFPMPGAKDARTVRLSLFADAGSVWDGKTYDDNSSSATGGRV

QNIYGAGNTHKSTFTNELRYSAGGAVTWLSPLGPMKFSYAYPLKKKPEDEI

QRFQFQLGTTF

In some embodiments, the heterologous carrier protein is an OMPC protein comprising amino acid substitutions to remove one or more N-linked glycosylation sites and/or to introduce lysine residues at surface exposed positions of the carrier. It is believed that removal of the N-linked glycosylation sites may improve accessibility of the protein surface for conjugation to the HIV-1 Env fusion peptide.

In some embodiments, the heterologous carrier protein is an Outer-membrane lipoprotein carrier protein comprising amino acid substitutions to remove one or more N-linked glycosylation sites. It is believed that removal of the N-linked glycosylation sites may improve accessibility of the protein surface for conjugation to the HIV-1 Env fusion peptide. An exemplary Outer-membrane lipoprotein carrier protein sequence with modifications to remove one or more N-linked glycosylation sites is provided as:

(SEQ ID NO: 223)
QAGAVDALKQFNNDADGISGSFTQTVQSKKKTQTAHGTFKILRPGLFKWEY

TSPYKQTIVGDGQTVWLYDVDLAQVTKSSQDQAIGGSPAAILSNKTALESS

YTLKEDGSSNGIDYVLATPKRNNAGYQYIRIGFKGGNLAAMQLKDSFGNQT

SISFGGLNTNPQLSRGAFKFTPPKGVDVLSN

In some embodiments, the heterologous carrier protein is a Outer-membrane lipoprotein carrier protein comprising amino acid substitutions to remove one or more N-linked glycosylation sites and/or to introduce lysine residues at surface exposed positions of the carrier. It is believed that removal of the N-linked glycosylation sites may improve accessibility of the protein surface for conjugation to the HIV-1 Env fusion peptide.

In some embodiments, the heterologous carrier protein is a Cholera Toxin B Subunit comprising amino acid substitutions to remove one or more N-linked glycosylation sites. It is believed that removal of the N-linked glycosylation sites may improve accessibility of the protein surface for conjugation to the HIV-1 Env fusion peptide. An exemplary Cholera Toxin B Subunit sequence with modifications to remove one or more N-linked glycosylation sites is provided as:

(SEQ ID NO: 224)
NGTPQNITDLCAEYHNTQIHTLNDKIFSYTESLAGKREMAIITFKNGATFQ

VEVPGSQHIDSQKKAIERMKDTLRIAYLTEAKVEKLCVWNNKTPHAIAAIS

MAN

In some embodiments, the heterologous carrier protein is a Cholera Toxin B Subunit comprising amino acid substitutions to remove one or more N-linked glycosylation sites and/or to introduce lysine residues at surface exposed positions of the carrier. It is believed that removal of the N-linked glycosylation sites may improve accessibility of the protein surface for conjugation to the HIV-1 Env fusion peptide.

Any one of the above disclosed heterologous carrier proteins can be fused to any one of the self-assembling protein nanoparticle subunits in the fusion protein of the self-assembling protein nanoparticle carrier.

3. Linker

The heterologous carrier protein fused to the self-assembling protein nanoparticle subunit can be direct linked (for example, the C-terminus of the heterologous carrier protein is linked to the N-terminus of the self-assembling protein nanoparticle subunit by a peptide bond), or indirectly linked by a peptide linker (for example, the C-terminus of the heterologous carrier protein is directly linked to the N-terminus of a peptide linker by a peptide bond, and the C-terminus of the peptide linker is directly linked to the N-terminus of the self-assembling protein nanoparticle subunit by a peptide bond). Any suitable linker can be used to fuse the heterologous carrier protein and the self-assembling protein nanoparticle. In some embodiments, the linker comprises a camel IgG2a hinge (referred to as caIgG2a, EPKIPQPQPKPQPQPQPQPKPQPKPEPE, SEQ ID NO: 327). In some embodiments, the linker comprises a CD8 hinge region, such as KPTTTPAPRPPTPAPTIASQPLSLRPEACRPAAGGAVHTRGLDFACD (SEQ ID NO: 328). In some embodiments, the linker comprises an antibody hinge sequence, such as ggsgEPKSDKTHTPPPAPELLgsgEPKSDKTHTPPPAPELLgsgg (SEQ ID NO: 329). In some embodiments, the linker comprises a flexible protein sequence, such as a glycine serine linker sequence, for example, GGGGSGGGGS (SEQ ID NO: 330).

The linker fusing the carrier protein and the self-assembling nanoparticle subunit can be any suitable length; in some embodiments, the linker is from 10-00 amino acids in length, such as from 10-50 amino acids in length.

In some embodiments, the fusion protein comprises or consists of a rTT carrier protein such as SEQ ID NO: 44 linked to any one of the self-assembling protein nanoparticle subunits provided herein by a peptide linker, such as a caIgG2a linker (e.g., SEQ ID NO: 327), a CD8 linker (e.g., SEQ ID NO: 328), an antibody hinge linker (e.g., SEQ ID NO: 329), or a flexible linker such as a glycine-serine linker (e.g., SEQ ID NO: 330).

In some embodiments, the fusion protein comprises or consists of a rTT carrier protein such as SEQ ID NO: 45 linked to any one of the self-assembling protein nanoparticle subunits provided herein by a peptide linker, such as a caIgG2a linker (e.g., SEQ ID NO: 327), a CD8 linker (e.g., SEQ ID NO: 328), an antibody hinge linker (e.g., SEQ ID NO: 329), or a flexible linker such as a glycine-serine linker (e.g., SEQ ID NO: 330).

In some embodiments, the fusion protein comprises or consists of a rTT carrier protein such as SEQ ID NO: 46 linked to any one of the self-assembling protein nanoparticle subunits provided herein by a peptide linker, such as a caIgG2a linker (e.g., SEQ ID NO: 327), a CD8 linker (e.g., SEQ ID NO: 328), an antibody hinge linker (e.g., SEQ ID NO: 329), or a flexible linker such as a glycine-serine linker (e.g., SEQ ID NO: 330).

In some embodiments, the fusion protein comprises or consists of a rTT carrier protein such as SEQ ID NO: 47 linked to any one of the self-assembling protein nanoparticle subunits provided herein by a peptide linker, such as a caIgG2a linker (e.g., SEQ ID NO: 327), a CD8 linker (e.g., SEQ ID NO: 328), an antibody hinge linker (e.g., SEQ ID NO: 329), or a flexible linker such as a glycine-serine linker (e.g., SEQ ID NO: 330).

In some embodiments, the fusion protein comprises or consists of a rTT carrier protein such as SEQ ID NO: 48 linked to any one of the self-assembling protein nanoparticle subunits provided herein by a peptide linker, such as a caIgG2a linker (e.g., SEQ ID NO: 327), a CD8 linker (e.g., SEQ ID NO: 328), an antibody hinge linker (e.g., SEQ ID NO: 329), or a flexible linker such as a glycine-serine linker (e.g., SEQ ID NO: 330).

In some embodiments, the fusion protein comprises or consists of a rTT carrier protein such as SEQ ID NO: 49 linked to any one of the self-assembling protein nanoparticle subunits provided herein by a peptide linker, such as a caIgG2a linker (e.g., SEQ ID NO: 327), a CD8 linker (e.g., SEQ ID NO: 328), an antibody hinge linker (e.g., SEQ ID NO: 329), or a flexible linker such as a glycine-serine linker (e.g., SEQ ID NO: 330).

In some embodiments, the fusion protein comprises or consists of a rTT carrier protein such as SEQ ID NO: 50 linked to any one of the self-assembling protein nanoparticle subunits provided herein by a peptide linker, such as a caIgG2a linker (e.g., SEQ ID NO: 327), a CD8 linker (e.g., SEQ ID NO: 328), an antibody hinge linker (e.g., SEQ ID NO: 329), or a flexible linker such as a glycine-serine linker (e.g., SEQ ID NO: 330).

In some embodiments, the fusion protein comprises or consists of a rTT carrier protein such as SEQ ID NO: 51 linked to any one of the self-assembling protein nanoparticle subunits provided herein by a peptide linker, such as a caIgG2a linker (e.g., SEQ ID NO: 327), a CD8 linker (e.g., SEQ ID NO: 328), an antibody hinge linker (e.g., SEQ ID NO: 329), or a flexible linker such as a glycine-serine linker (e.g., SEQ ID NO: 330).

In some embodiments, the fusion protein comprises or consists of a rTT carrier protein such as SEQ ID NO: 52 linked to any one of the self-assembling protein nanoparticle subunits provided herein by a peptide linker, such as a caIgG2a linker (e.g., SEQ ID NO: 327), a CD8 linker (e.g., SEQ ID NO: 328), an antibody hinge linker (e.g., SEQ ID NO: 329), or a flexible linker such as a glycine-serine linker (e.g., SEQ ID NO: 330).

In some embodiments, the fusion protein comprises or consists of a rTT carrier protein such as SEQ ID NO: 53 linked to any one of the self-assembling protein nanoparticle subunits provided herein by a peptide linker, such as a caIgG2a linker (e.g., SEQ ID NO: 327), a CD8 linker (e.g., SEQ ID NO: 328), an antibody hinge linker (e.g., SEQ ID NO: 329), or a flexible linker such as a glycine-serine linker (e.g., SEQ ID NO: 330).

In some embodiments, the fusion protein comprises or consists of a rTT carrier protein such as SEQ ID NO: 54 linked to any one of the self-assembling protein nanoparticle subunits provided herein by a peptide linker, such as a caIgG2a linker (e.g., SEQ ID NO: 327), a CD8 linker (e.g., SEQ ID NO: 328), an antibody hinge linker (e.g., SEQ ID NO: 329), or a flexible linker such as a glycine-serine linker (e.g., SEQ ID NO: 330).

In some embodiments, the fusion protein comprises or consists of a rTT carrier protein such as SEQ ID NO: 55 linked to any one of the self-assembling protein nanoparticle subunits provided herein by a peptide linker, such as a caIgG2a linker (e.g., SEQ ID NO: 327), a CD8 linker (e.g., SEQ ID NO: 328), an antibody hinge linker (e.g., SEQ ID NO: 329), or a flexible linker such as a glycine-serine linker (e.g., SEQ ID NO: 330).

In some embodiments, the fusion protein comprises or consists of a rTT carrier protein such as SEQ ID NO: 56 linked to any one of the self-assembling protein nanoparticle subunits provided herein by a peptide linker, such as a caIgG2a linker (e.g., SEQ ID NO: 327), a CD8 linker (e.g., SEQ ID NO: 328), an antibody hinge linker (e.g., SEQ ID NO: 329), or a flexible linker such as a glycine-serine linker (e.g., SEQ ID NO: 330).

In some embodiments, the fusion protein comprises or consists of a rTT carrier protein such as SEQ ID NO: 57 linked to any one of the self-assembling protein nanoparticle subunits provided herein by a peptide linker, such as a caIgG2a linker (e.g., SEQ ID NO: 327), a CD8 linker (e.g., SEQ ID NO: 328), an antibody hinge linker (e.g., SEQ ID NO: 329), or a flexible linker such as a glycine-serine linker (e.g., SEQ ID NO: 330).

In some embodiments, the fusion protein comprises or consists of a rTT carrier protein such as SEQ ID NO: 58 linked to any one of the self-assembling protein nanoparticle subunits provided herein by a peptide linker, such as a caIgG2a linker (e.g., SEQ ID NO: 327), a CD8 linker (e.g., SEQ ID NO: 328), an antibody hinge linker (e.g., SEQ ID NO: 329), or a flexible linker such as a glycine-serine linker (e.g., SEQ ID NO: 330).

In some embodiments, the fusion protein comprises or consists of a rTT carrier protein such as SEQ ID NO: 59 linked to any one of the self-assembling protein nanoparticle subunits provided herein by a peptide linker, such as a caIgG2a linker (e.g., SEQ ID NO: 327), a CD8 linker (e.g., SEQ ID NO: 328), an antibody hinge linker (e.g., SEQ ID NO: 329), or a flexible linker such as a glycine-serine linker (e.g., SEQ ID NO: 330).

In some embodiments, the fusion protein comprises or consists of a rTT carrier protein such as SEQ ID NO: 60 linked to any one of the self-assembling protein nanoparticle subunits provided herein by a peptide linker, such as a caIgG2a linker (e.g., SEQ ID NO: 327), a CD8 linker (e.g., SEQ ID NO: 328), an antibody hinge linker (e.g., SEQ ID NO: 329), or a flexible linker such as a glycine-serine linker (e.g., SEQ ID NO: 330).

In some embodiments, the fusion protein comprises or consists of a rTT carrier protein such as SEQ ID NO: 61 linked to any one of the self-assembling protein nanoparticle subunits provided herein by a peptide linker, such as a caIgG2a linker (e.g., SEQ ID NO: 327), a CD8 linker (e.g., SEQ ID NO: 328), an antibody hinge linker (e.g., SEQ ID NO: 329), or a flexible linker such as a glycine-serine linker (e.g., SEQ ID NO: 330).

In some embodiments, the fusion protein comprises or consists of a rTT carrier protein such as SEQ ID NO: 62 linked to any one of the self-assembling protein nanoparticle subunits provided herein by a peptide linker, such as a caIgG2a linker (e.g., SEQ ID NO: 327), a CD8 linker (e.g., SEQ ID NO: 328), an antibody hinge linker (e.g., SEQ ID NO: 329), or a flexible linker such as a glycine-serine linker (e.g., SEQ ID NO: 330).

In some embodiments, the fusion protein comprises or consists of a rTT carrier protein such as SEQ ID NO: 63 linked to any one of the self-assembling protein nanoparticle subunits provided herein by a peptide linker, such as a caIgG2a linker (e.g., SEQ ID NO: 327), a CD8 linker (e.g., SEQ ID NO: 328), an antibody hinge linker (e.g., SEQ ID NO: 329), or a flexible linker such as a glycine-serine linker (e.g., SEQ ID NO: 330).

In some embodiments, the fusion protein comprises or consists of a rTT carrier protein such as SEQ ID NO: 64 linked to any one of the self-assembling protein nanoparticle subunits provided herein by a peptide linker, such as a caIgG2a linker (e.g., SEQ ID NO: 327), a CD8 linker (e.g., SEQ ID NO: 328), an antibody hinge linker (e.g., SEQ ID NO: 329), or a flexible linker such as a glycine-serine linker (e.g., SEQ ID NO: 330).

In some embodiments, the fusion protein comprises or consists of a HiD carrier protein such as SEQ ID NO: 65 linked to any one of the self-assembling protein nanoparticle subunits provided herein by a peptide linker, such as a caIgG2a linker (e.g., SEQ ID NO: 327), a CD8 linker (e.g., SEQ ID NO: 328), an antibody hinge linker (e.g., SEQ ID NO: 329), or a flexible linker such as a glycine-serine linker (e.g., SEQ ID NO: 330).

In some embodiments, the fusion protein comprises or consists of a CRM197 carrier protein such as SEQ ID NO: 66 linked to any one of the self-assembling protein nanoparticle subunits provided herein by a peptide linker, such as a caIgG2a linker (e.g., SEQ ID NO: 327), a CD8 linker (e.g., SEQ ID NO: 328), an antibody hinge linker (e.g., SEQ ID NO: 329), or a flexible linker such as a glycine-serine linker (e.g., SEQ ID NO: 330).

In some embodiments, the fusion protein comprises or consists of a CRM197 carrier protein such as SEQ ID NO: 67 linked to any one of the self-assembling protein nanoparticle subunits provided herein by a peptide linker, such as a caIgG2a linker (e.g., SEQ ID NO: 327), a CD8 linker (e.g., SEQ ID NO: 328), an antibody hinge linker (e.g., SEQ ID NO: 329), or a flexible linker such as a glycine-serine linker (e.g., SEQ ID NO: 330).

In some embodiments, the fusion protein comprises or consists of a OMPC carrier protein such as SEQ ID NO: 222 linked to any one of the self-assembling protein nanoparticle subunits provided herein by a peptide linker, such as a caIgG2a linker (e.g., SEQ ID NO: 327), a CD8 linker (e.g., SEQ ID NO: 328), an antibody hinge linker (e.g., SEQ ID NO: 329), or a flexible linker such as a glycine-serine linker (e.g., SEQ ID NO: 330).

In some embodiments, the fusion protein comprises or consists of a Outer-membrane lipoprotein carrier protein such as SEQ ID NO: 223 linked to any one of the self-assembling protein nanoparticle subunits provided herein by a peptide linker, such as a caIgG2a linker (e.g., SEQ ID NO: 327), a CD8 linker (e.g., SEQ ID NO: 328), an antibody hinge linker (e.g., SEQ ID NO: 329), or a flexible linker such as a glycine-serine linker (e.g., SEQ ID NO: 330).

In some embodiments, the fusion protein comprises or consists of a Cholera Toxin B Subunit carrier protein such as SEQ ID NO: 224 linked to any one of the self-assembling protein nanoparticle subunits provided herein by a peptide linker, such as a caIgG2a linker (e.g., SEQ ID NO: 327), a CD8 linker (e.g., SEQ ID NO: 328), an antibody hinge linker (e.g., SEQ ID NO: 329), or a flexible linker such as a glycine-serine linker (e.g., SEQ ID NO: 330).

4. Heterologous T-Cell Helper Epitope

In some embodiments, the fusion protein further comprises a heterologous T-cell helper epitope sequence. It is believed that the presence of the heterologous T-cell helper epitope sequence on the self-assembling protein nanoparticle carrier will improve the immune response elicited by an immunogenic conjugate containing the carrier conjugated to HIV-1 Env fusion peptides as disclosed herein. Any suitable heterologous T-cell helper epitope sequence can be included on the fusion protein. In some embodiments, the amino acid sequence of the T-cell helper epitope is the sequence of a pan DR epitope (PADRE), such as AKFVAAWTLKAAA (SEQ ID NO: 221). In some embodiments, the amino acid sequence of the T-cell helper epitope is the sequence of a P2 epitope, such as QYIKANSKFIGITEL (SEQ ID NO: 68). In some embodiments, the amino acid sequence of the T-cell helper epitope is the sequence of a TpD epitope, such as ILMQYIKANSKFIGKVSVRQSIALSSLMVAQ (SEQ ID NO: 69). In some embodiments, the amino acid sequence of the T-cell helper epitope is the sequence of an HIV-1 Env epitope, such as HIV-1 Env residues 31-45 according to the HXB2 numbering system, for example, AENLWVTVYYGVPVW (SEQ ID NO: 70) or TEKLWVTVYYGVPVW (SEQ ID NO: 71). In some embodiemnts, the amino acid sequence of the T-cell helper epitope is selected from any one of:
  (a) SEQ ID NO: 67;
  (b) SEQ ID NO: 68;
  (c) SEQ ID NO: 69;
  (d) the sequence of HIV-1 Env residues 31-45 according to the HXB2 numbering system (Env31-45 epitope); or
  (e) a combination of any one of (a) and (b); (a) and (c); (a) and (d); (b) and (c); (b) and (d); (c) and (d); (a), (b), and (c); (a), (b), and (d); (a), (c), and (d); (b), (c), and (d); or (a), (b), (c), and (d).

In some embodiments, the amino acid sequence of the T-cell helper epitope is the sequence of a p458m epitope, such as NEDQKIGIEIIKRALKI (SEQ ID NO: 225). In some embodiments, the amino acid sequence of the T-cell helper epitope is the sequence of a P30 epitope, such as FNNFTVSFWLRVPKVSASHLE (SEQ ID NO: 226). In some embodiments, the amino acid sequence of the T-cell helper epitope is the sequence of a diphtheria toxin epitope, such as PVFAGANYAAWAVNVAQVI (DTD271-290, SEQ ID NO: 227), HHNTEEIVAQSIALSSLMV (DTD321-340, SEQ ID NO: 228), QSIALSSLMVAQAIPLVGEL (DTD331-350, SEQ ID NO: 229), VDIGFAAYNFVESIINLFQV (DTD351-370, SEQ ID NO: 230), QGESGHDIKITAENTPLPIA (DTD411-430, SEQ ID NO: 231), or GVLLPTIPGKLDVNKSKTHI (DTD431-450, SEQ ID NO: 232). In some embodiments, the amino acid sequence of the T-cell helper epitope is the sequence of a tetanus toxin epitope, such as NSVDDALINSTKIYSYFPSV (TT 580-599, SEQ ID NO: 233), QYIKANSKFIGITEL (TT 830-844, SEQ ID NO: 234), PGINGKAIHLVNNESSE (TT, 916-932, SEQ ID NO: 235), FNNFTVSFWLRVPKVSASHLE (TT, 947-967, SEQ ID NO: 236). In some embodiments, the amino acid sequence of the T-cell helper epitope is the sequence of an HIV-1 Env epitope, such as TQLFNSTWFNSTWST (HIV-1 Env 388-402, SEQ ID NO: 237), EQIWNHTTWMEWDRE (HIV-1 Env 620-634, SEQ ID NO: 238), IRGQIRCSSNITGLLL-TRDGGNNAAA (HIV_env_DRBO101_1, SEQ ID NO: 239), QCTHGIRPVVSTQLLLNGSLAEE (HIV_env_DRBO101_2, SEQ ID NO: 240), NDNTSYRLISCNTSVITQACPKV (HIV_env_DRBO101_3, SEQ ID NO: 241), SENFTNNAKIIIVQLNESVVINC (HIV_env_DRBO101_5, SEQ ID NO: 242), EVVIRSENFTNNAKTIIVQLNES (HIV_env_DRBO101_7, SEQ ID NO: 243), TVQCTHGIRPVVSTQLLLNGSLA (HIV_env_DRBO101_11, SEQ ID NO: 244), or ESVVINCTRPNNNTRRSIHIGPG (HIV_env_DRBO101_14, SEQ ID NO: 245).

The heterologous T-cell helper epitope can be located at any suitable section of the fusion protein, including (but not limited to) the N-terminus, the C-terminus, and between the heterologous carrier protein and the self-assembling protein nanoparticle subunit. In some embodiments, the heterologous T-cell helper epitope is separated from the carrier protein and/or the self-assembling protein nanoparticle subunit in the fusion protein by one or more peptide linkers.

5. Targeting Moiety

In some embodiments, the immunogenic conjugate further includes a moiety that targets the immune system in a subject to enhance the immune response to the HIV-1 Env fusion peptide on the immunogenic conjugate. The moiety can be, for example, a moiety that binds to components of the immune system in the subject, such as a pattern recognition receptor, a dendritic cell, or to antigens located in B-cell developmental regions of the immune system, such as germinal centers.

In some embodiments, the fusion protein is linked to a moiety that specifically binds to a pattern recognition receptor agonist, such as a toll-like receptor (TLR) agonist, a Stimulator of Interferon Genes (STING) agonist, a C-type lectin receptor (CLR) agonist, a RIG-I-like receptor (RLR) agonist, or a NOD-like receptor (NLR) agonist.

In several embodiments, the moiety can be a pattern recognition receptor agonist. Non-limiting examples of pattern recognition receptor agonists include TLR-1/2/6 agonists (e.g., lipopeptides and glycolipids, such as Pam2cys or Pam3cys lipopeptides); TLR-3 agonists (e.g., dsRNA, such as PolyI:C, and nucleotide base analogs); TLR-4 agonist (e.g., lipopolysaccharide (LPS) derivatives and small molecule analogs of pyrimidoindole); TLR5 agonists (e.g., Flagellin); TLR-7/8 agonists (e.g., ssRNA and nucleotide base analogs, including derivatives of imidazoquinolines, hydroxy-adenine, benzonapthyridine and loxoribine); and TLR-9 agonists (e.g., unmethylated CpG); Stimulator of Interferon Genes (STING) agonists (e.g., cyclic dinucleotides, such as cyclic diadenylate monophosphate); C-type lectin receptor (CLR) agonists (such as various mono, di, tri and polymeric sugars that can be linear or branched, e.g., mannose, Lewis-X tri-saccharides, etc.); RIG-I-like receptor (RLR) agonists; and NOD-like receptor (NLR) agonists (such as peptidogylcans and structural motifs from bacteria, e.g., meso-diaminopimelic acid and muramyl dipeptide); and combinations thereof. In several embodiments, the pattern recognition receptor agonist can be a TLR agonist, such as an imidazoquinoline-based TLR-7/8 agonist. For example, the adjuvant can be Imiquimod (R837) or Resiquimod (R848), which are approved by the FDA for human use.

In several embodiments, the moiety can be a TLR-7 agonist, a TLR-8 agonist and/or a TLR-7/8 agonist. Numerous such agonists are known, including many different imidazoquinoline compounds. Imidazoquinolines are synthetic immunomodulatory drugs that act by binding Toll-like receptors 7 and 8 (TLR-7/TLR-8) on antigen presenting cells (e.g., dendritic cells), structurally mimicking these receptors' natural ligand, viral single-stranded RNA. Imidazoquinolines are heterocyclic compounds comprising a fused quinoline-imidazole skeleton. Derivatives, salts (including hydrates, solvates, and N-oxides), and prodrugs thereof also are contemplated by the present disclosure. Particular imidazoquinoline compounds are known in the art, see for example, U.S. Pat. Nos. 6,518,265; and 4,689,338. In some non-limiting embodiments, the imidazoquinoline compound is not imiquimod and/or is not resiquimod.

The moiety that targets the immune system in a subject can be linked to the immunogenic conjugate by any suitable means.

In some embodiments, the fusion protein includes the sequence of flagellin subunit.

In some embodiments, the fusion protein of the self-assembling protein-nanoparticle carrier includes a streptavidin sequence, and the moiety that targets the immune system in a subject is biotinylated, for example, a biotinylated pattern recognition receptor agonist, such as a biotinylated TLR agonist, a biotinylated STING agonist, a biotinylated CLR agonist, a biotinylated RLR agonist, or a biotinylated NLR agonist. The biotinylated moiety can be linked to the self-assembling protein-nanoparticle carrier.

In some embodiments, the moiety that targets the immune system in the subject is conjugated to the self-assembling protein nanoparticle carrier using the same conjugate method as that used to conjugate the HIV-1 Env fusion peptide to the self-assembling protein nanoparticle carrier.

In some such embodiments, conjugation of the moiety that targets the immune system and the HIV-1 fusion peptide to the self-assembling protein nanoparticle carrier can be completed in the same reaction. For example, both the moiety that targets the immune system in the subject and the HIV-1 Env fusion peptide can be linked to a cysteine residue for conjugation to the self-assembling protein nanoparticle carrier as described herein. In some embodiments, the HIV-1 Env fusion peptide linked to a cysteine residue is mixed with a small amount of TLR-7 or 8 agonist modified to include a reactive —SH group, so that both the HIV-1 Env fusion peptide and the TLR7/8-agonist are conjugated via a single reaction to a bifunctional crosslinker-activated self-assembled protein nanoparticle carrier.

6. Exemplary Fusion Protein Embodiments

In several embodiments, the fusion proteins of the self-assembling protein nanoparticle carrier comprise, consist essentially of, or consist of the amino acid sequence of any one of fusion proteins listed in the following table (showing SEQ ID NOs: 72-219, 246-257, and 331-397), or an amino acid sequence at least 90% (such as at least 95%) identical to any one of SEQ ID NOs: 72-219, 246-257, or 331-397 that self-assembles into a protein nanoparticle under suitable conditions. In some embodiments, the fusion proteins of the self-assembling protein nanoparticle carrier comprise, consist essentially of, or consist of the amino acid sequence set forth as any one of SEQ ID NOs: 73, 76, 79, 100, 101, 109, 116, 167, 172, 180, 197, or 211, or an amino acid sequence at least 90% (such as at least 95%) identical to any one of SEQ ID NOs: 73, 76, 79, 100, 101, 109, 116, 167, 172, 180, 197, or 211 that self-assembles into a protein nanoparticle under suitable conditions.

TABLE 1

Exemplary sequences of fusion proteins containing a protein nanoparticle subunit fused to a heterologous carrier protein and optionally a heterologous T-cell helper epitope.

| SEQ ID NO | Name | Sequence |
|---|---|---|
| Lumazine Synthase | | |
| 72 | LS-20-CRM | QIYEGKLTAEGLRFGIVASRFNHALVDRLVEGAIDAIVRHGGREEDITLVRVPGSWEIPVAA GELARKEnIsAVIAIGVLIRGATPHFDYIASEVSKGLADLSLELRKPITFGVITADTLEQAI ERAGTKHGNKGWEAALSAIEMANLFKSLRggksggnkksdgvkessesgGADDVVDSSKSFV MENFSSYHGTKPGYVDSIQKGIQKPKSGTQGNYDDDWKEFYSTDNKYDAAGYSVDNENPLSG KAGGVVKVTYPGLTKVLALKVDNAETIKKELGLSLTEPLMEQVGTEEFIKRFGDGASRVVLS LPFAEGSSSVEYINNWEQAKALSVELEINFETRGKRGQDAMYEYMAQACAGNRVRRSVGSSL SCINLDWDVIRDKTKTKIESLKEHGPIKNKMSESPNKTVSEEKAKQYLEEFHQTALEHPELS ELKTVTGTNPVFAGANYAAWAVNVAQVIDSETADNLEKTTAALSILPGIGSVMGIADGAVHH NTEEIVAQSIALSSLMVAQAIPLVGELVDIGFAAYNFVESIINLFQVVHNSYNRPAYSPGHK TQPFLHDGYAVSWNTVEDSIIRTGFQGESGHDIKITAENTPLPIAGVLLPTIPGKLDVNKSK THISVNGRKIRMRCRAIDGDVTFCRPKSPVYVGNGVHANLHVAFHRSSSEKIHSNEISSDSI GVLGYQKTVDHTKVNSKLSLFFEIKS |
| 73 | LS-20-rTT | QIYEGKLTAEGLRFGIVASRFNHALVDRLVEGAIDAIVRHGGREEDITLVRVPGSWEIPVAA GELARKEnIsAVIAIGVLIRGATPHFDYIASEVSKGLADLSLELRKPITFGVITADTLEQAI ERAGTKHGNKGWEAALSAIEMANLFKSLRggksggnkksdgvkessesgMKNLDCWVDNEED IDVILKKSTILNLDINNDIISDISGFNSSVITYPDAQLVPGINGKAIHLVNNESSEVIVHKA MDIEYNDMFNNFTVSFWLRVPKVSASHLEQYGTNEYSIISSMKKHSLSIGSGWSVSLKGNNL IWTLKDSAGEVRQITFRDLPDKFNAYLANKWVFITITNDRLSSANLYINGVLMGSAEITGLG AIREDNNITLKLDRCNNNNQYVSIDKFRIFCKALNPKEIEKLYTSYLSITFLRDFWGNPLRY DTEYYLIPVASSSKDVQLKNITDYMYLTNAPSYTNGKLNIYYRRLYNGLKFIIKRYTPNNEI DSFVKSGDFIKLYVSYNNNEHIVGYPKDGNAFNNLDRILRVGYNAPGIPLYKKMEAVKLRDL KTYSVQLKLYDDKNASLGLVGTHNGQIGNDPNRDILIASNWYFNHLKDKILGCDWYFVPTDE GWTND |
| 74 | LS-20-HID | QIYEGKLTAEGLRFGIVASRFNHALVDRLVEGAIDAIVRHGGREEDITLVRVPGSWEIPVAA GELARKEnIsAVIAIGVLIRGATPHFDYIASEVSKGLADLSLELRKPITFGVITADTLEQAI ERAGTKHGNKGWEAALSAIEMANLFKSLRggksggnkksdgvkessesgSNMANTQMKSDKI IIAHRGASGYLPEHTLESKALAFAQQADYLEQDLAMTKDGRLVVIHDHFLDGLTDVAKKFPH RHRKDGRYYVIDFTLKEIQSLEMTENFETKDGKQAQVYPNRFPLWKSHFRIHTFEDEIEFIQ GLEKSTGKKVGIYPEIKAPWFHHQNGKDIAAETLKVLKKYGYDKKTDMVYLQTFDFNELKRI |

TABLE 1-continued

Exemplary sequences of fusion proteins containing a protein nanoparticle subunit fused to a heterologous carrier protein and optionally a heterologous T-cell helper epitope.

| SEQ ID NO | Name | Sequence |
|---|---|---|
| | | KTELLPQMGMDLKLVQLIAYTDWKETQEKDPKGYWVNYNYDWMFKPGAMAEVVKYADGVGPG WYMLVNKEESKPDNIVYTPLVKELAQYNVEVHPYTVRKDALPEFFTDVNQMYDALLNKSGAT GVFTDFPDTGVEFLKGIK |
| 75 | LS-PADRE-Env31-CRM | *QIYEGKLTAEGLRFGIVASRFNHALVDRLVEGAIDAIVRHGGREEDITLVRVPGSWEIPVAA GELARKEnIsAVIAIGVLIRGATPHFDYIASEVSKGLADLSLELRKPITFGVITADTLEQAI ERAGTKHGNKGWEAALSAIEMANLFKSLRSLVRA*KFVAAWTLKAAA*GSLVRA*ENLWVTVYYG VPVW*slvrg*GADDVVDSSKSFVMENFSSYHGTKPGYVDSIQKGIQKPKSGTQGNYDDDWKEF YSTDNKYDAAGYSVDNENPLSGKAGGVVKVTYPGLTKVLALKVDNAETIKKELGLSLTEPLM EQVGTEEFIKRFGDGASRVVLSLPFAEGSSSVEYINNWEQAKALSVELEINFETRGKRGQDA MYEYMAQACAGNRVRRSVGSSLSCINLDWDVIRDKTKTKIESLKEHGPIKNKMSESPNKTVS EEKAKQYLEEFHQTALEHPELSELKTVTGTNPVFAGANYAAWAVNVAQVIDSETADNLEKTT AALSILPGIGSVMGIADGAVHHNTEEIVAQSIALSSLMVAQAIPLVGELVDIGFAAYNFVES IINLFQVVHNSYNRPAYSPGHKTQPFLHDGYAVSWNTVEDSIIRTGFQVGESGHDIKITAENT PLPIAGVLLPTIPGKLDVNKSKTHISVNGRKIRMRCRAIDGDVTFCRPKSPVYVGNGVHANL HVAFHRSSSEKIHSNEISSDSIGVLGYQKTVDHTKVNSKLSLFFEIKS |
| 76 | LS-PADRE-Env31-rTT | *QIYEGKLTAEGLRFGIVASRFNHALVDRLVEGAIDAIVRHGGREEDITLVRVPGSWEIPVAA GELARKEnIsAVIAIGVLIRGATPHFDYIASEVSKGLADLSLELRKPITFGVITADTLEQAI ERAGTKHGNKGWEAALSAIEMANLFKSLRSLVRSLVRA*KFVAAWTLKAAA*GSLVRA*ENLWVT VYYGVPVW*slvrg*MKNLDCWVDNEEDIDVILKKSTILNLDINNDIISDISGFNSSVITYPDA QLVPGINGKAIHLVNNESSEVIVHKAMDIEYNDMFNNFTVSFWLRVPKVSASHLEQYGTNEY SIISSMKKHSLSIGSGWSVSLKGNNLIWTLKDSAGEVRQITFRDLPDKFNAYLANKWVFITI TNDRLSSANLYINGVLMGSAEITGLGAIREDNNITLKLDRCNNNNQYVSIDKFRIFCKALNP KEIEKLYTSYLSITFLRDFWGNPLRYDTEYYLIPVASSSKDVQLKNITDYMYLTNAPSYTNG KLNIYYRRLYNGLKFIIKRYTPNNEIDSFVKSGDFIKLYVSYNNNEHIVGYPKDGNAFNNLD RILRVGYNAPGIPLYKKMEAVKLRDLKTYSVQLKLYDDKNASLGLVGTHNGQIGNDPNRDIL IASNWYFNHLKDKILGCDWYFVPTDEGWTND |
| 77 | LS-PADRE-Env31-HID | *QIYEGKLTAEGLRFGIVASRFNHALVDRLVEGAIDAIVRHGGREEDITLVRVPGSWEIPVAA GELARKEnIsAVIAIGVLIRGATPHFDYIASEVSKGLADLSLELRKPITFGVITADTLEQAI ERAGTKHGNKGWEAALSAIEMANLFKSLRSLVRAKFVAAWTLKAAAGSLVRAENLWVT VYYGVPVW*slvrg*SNMANTQMKSDKIIIAHRGASGYLPEHTLESKALAFAQQADYLEQDLAM TKDGRLVVIHDHFLDGLTDVAKKFPHRHRKDGRYYVIDFTLKEIQSLEMTENFETKDGKQAQ VYPNRFPLWKSHFRIHTFEDEIEFIQGLEKSTGKKVGIYPEIKAPWFHHQNGKDIAAETLKV LKKYGYDKKTDMVYLQTFDFNELKRIKTELLPQMGMDLKLVQLIAYTDWKETQEKDPKGYWV NYNYDWMFKPGAMAEVVKYADGVGPGWYMLVNKEESKPDNIVYTPLVKELAQYNVEVHPYTV RKDALPEFFTDVNQMYDALLNKSGATGVFTDFPDTGVEFLKGIK |
| 78 | rTT_degly-LS | MKNLDCWVDNEEDIDVILKKSTILNLDINNDIISDISGFNSAVITYPDAQLVPGINGKAIHL VNNEASEVIVHKAMDIEYNDMFNNFTVSFWLRVPKVSASHLEQYGTNEYSIISSMKKHSLSI GSGWSVSLKGNNLIWTLKDSAGEVRQITFRDLPDKFNAYLANKWVFITITNDRLSSANLYIN GVLMGSAEITGLGAIREDNQITLKLDRCNNNNQYVSIDKFRIFCKALNPKEIEKLYTSYLSI TFLRDFWGNPLRYDTEYYLIPVASSSKDVQLKQITDYMYLTNAPSYTNGKLNIYYRRLYNGL KFIIKRYTPNNEIDSFVKSGDFIKLYVSYNNNEHIVGYPKDGNAFNNLDRILRVGYNAPGIP LYKKMEAVKLRDLKTYSVQLKLYDDKQASLGLVGTHNGQIGNDPNRDILIASNWYFNHLKDK ILGCDWYFVPTDEGWTNDgggsgggsgggs*MQIYEGKLTAEGLRFGIVASRFNHALVDRLVE GAIDCIVRHGGREEDITLVRVPGSWEIPVAAGELARKEDIDAVIAIGVLIRGATPHFDYIAS EVSKGLADLSLELRKPITFGVITADTLEQAIERAGTKHGNKGWEAALSAIEMANLFKSLR* |
| 79 | LS-rTT_degly | *QIYEGKLTAEGLRFGIVASRFNHALVDRLVEGAIDCIVRHGGREEDITLVRVPGSWEIPVAA GELARKEDIDAVIAIGVLIRGATPHFDYIASEVSKGLADLSLELRKPITFGVITADTLEQAI ERAGTKHGNKGWEAALSAIEMANLFKSLR*ggsggGSGGGQMKNLDCWVDNEEDIDVILKKST ILNLDINNDIISDISGFNSAVITYPDAQLVPGINGKAIHLVNNEASEVIVHKAMDIEYNDMF NNFTVSFWLRVPKVSASHLEQYGTNEYSIISSMKKHSLSIGSGWSVSLKGNNLIWTLKDSAG EVRQITFRDLPDKFNAYLANKWVFITITNDRLSSANLYINGVLMGSAEITGLGAIREDNQIT LKLDRCNNNNQYVSIDKFRIFCKALNPKEIEKLYTSYLSITFLRDFWGNPLRYDTEYYLIPV ASSSKDVQLKQITDYMYLTNAPSYTNGKLNIYYRRLYNGLKFIIKRYTPNNEIDSFVKSGDF IKLYVSYNNNEHIVGYPKDGNAFNNLDRILRVGYNAPGIPLYKKMEAVKLRDLKTYSVQLKL YDDKQASLGLVGTHNGQIGNDPNRDILIASNWYFNHLKDKILGCDWYFVPTDEGWTND |
| 80 | rTT_degly-10f-LS | MKNLDCWVDNEEDIDVILKKSTILNLDINNDIISDISGFNSAVITYPDAQLVPGINGKAIHL VNNEASEVIVHKAMDIEYNDMFNNFTVSFWLRVPKVSASHLEQYGTNEYSIISSMKKHSLSI GSGWSVSLKGNNLIWTLKDSAGEVRQITFRDLPDKFNAYLANKWVFITITNDRLSSANLYIN GVLMGSAEITGLGAIREDNQITLKLDRCNNNNQYVSIDKFRIFCKALNPKEIEKLYTSYLSI TFLRDFWGNPLRYDTEYYLIPVASSSKDVQLKQITDYMYLTNAPSYTNGKLNIYYRRLYNGL KFIIKRYTPNNEIDSFVKSGDFIKLYVSYNNNEHIVGYPKDGNAFNNLDRILRVGYNAPGIP LYKKMEAVKLRDLKTYSVQLKLYDDKQASLGLVGTHNGQIGNDPNRDILIASNWYFNHLKDK ILGCDWYFVPTDEGWTNDggggsaeaaakeaaakagggsgggsgggsgggsgggsgggsgg ggsggGG*MQIYEGKLTAEGLRFGIVASRENHALVDRLVEGCIDCIVRHGGREEDITLVRVPG SWEIPVAAGELARKEDIDAVIAIGVLIRGATPHFDYIASEVSKGLANLSLELRKPITFGVIT ADTLEQAIERAGTKHGNKCWEAALSAIEMANLFKSLR* |

TABLE 1-continued

Exemplary sequences of fusion proteins containing a protein nanoparticle subunit fused to a heterologous carrier protein and optionally a heterologous T-cell helper epitope.

| SEQ ID NO | Name | Sequence |
|---|---|---|
| 81 | rTT_degly-r8-LS | MKNLDCWVDNEEDIDVILKKSTILNL

TABLE 1-continued

Exemplary sequences of fusion proteins containing a protein nanoparticle subunit fused to a heterologous carrier protein and optionally a heterologous T-cell helper epitope.

| SEQ ID NO | Name | Sequence |
|---|---|---|
| | | GVLMGSAEITGLGAIREDNQITLKLDRCNNNQYV TABLE 1-continued Exemplary sequences of fusion proteins containing a protein nanoparticle subunit fused to a heterologous carrier protein and optionally a heterologous T-cell helper epitope.

| SEQ ID NO | Name | Sequence |
|---|---|---|
| | | REDNQITLKLDRCNNNNQYVSIDKFRIFCKALNPKEIE TABLE 1-continued Exemplary sequences of fusion proteins containing a protein nanoparticle subunit fused to a heterologous carrier protein and optionally a heterologous T-cell helper epitope.

| SEQ ID NO | Name | Sequence |
|---|---|---|
| 100 | LS-alphaLinker-rTT | MQIYEGKLTAEGLRFGIVASRFNHALVDRLVEGAIDAIVRHGGREEDITLVRVPGSWEIPVA AGELARKENISAVIAIGVLIRGATPHFDYIASEVSKGLADLSLELRKPITFGVITADTLEQA IERAGTKHGNKGWEAALSA/EMANLFKSLRsgsaKALEAQKQKMKNLDCWVDNEEDIDVILK KSTILNLDINNDIISDISGFNSSVITYPDAQLVPGINGKAIHLVNNESSEVIVHKAMDIEYN DMFNNFTVSFWLRVPKVSASHLEQYGTNEYSIISSMKKHSLSIGSGWSVSLKGNNLIWTLKD SAGEVRQITFRDLPDKFNAYLANKWVFITITNDRLSSANLYINGVLMGSAEITGLGAIREDN NITLKLDRCNNNQYVSIDKFRIFCKALNPKEIEKLYTSYLSITFLRDFWGNPLRYDTEYYL IPVASSSKDVQLKNITDYMYLTNAPSYTNGKLNIYYRRLYNGLKFIIKRYTPNNEIDSFVKS GDFIKLYVSYNNNEHIVGYPKDGNAFNNLDRILRVGYNAPGIPLYKKMEAVKLRDLKTYSVQ LKLYDDKNASLGLVGTHNGQIGNDPNRDILIASNWYFNHLKDKILGCDWYFVPTDEGWTND |
| 101 | rTT-LS-PADRE-SaTyflagellin-CC-YW | MKNLDCWVDNEEDIDVILKKSTILNLDINNDIISDISGFNSSVITYPDAQLVPGINGKAIHL VNNESSEVIVHKAMDIEYNDMFNNFTVSFWLRVPKVSASHLEQYGTNEYSIISSMKKHSLSI GSGWSVSLKGNNLIWTLKDSAGEVRQITFRDLPDKFNAYLANKWVFITITNDRLSSANLYIN GVLMGSAEITGLGAIREDNNITLKLDRCNNNQYVSIDKFRIFCKALNPKEIEKLYTSYLSI TTTMLATRNFSGGKSGGNKKSDGVKESSESTNTTIEDEDmqiyegkltaeglrfgivasrfn halvdrlvegaidaivrhggreeditlvrvpgsweipvaagelarkeNiSaviaigvlirgL EVLFQGPGAKFVAAWTLKAAAGDEVDatphfdyiasevskgladlslelrkpitfgvitadt leqaieragtkhgnkgweaalsaiemanlfkslrGGKSGGNKKSDGVNLTDLGLTQSNIQKL DIDITEGDNAGVQITLTNDQALVKVGNFQTQGSVRDIENLRQTIEAQISDLDSQSNTSNASQ VALERVRQLNNNIENLAGETTQAISIGDNANRSAQTLGKINATFRNAIAQGAADDKASNIRL GSSLREIATGLASQSKNLNNQTLLSLSNTNIVQAGSGSARLLSLVNQPVQNAQALVSTGAQQ LIQARSMNSVETAYDSDEIRSRASTLNNVTNGLNTIASNFRNQVAGLDSRLTDVQALAADIK QLPNE |
| 102 | rTT-LS-PADRE-SaTyflagellin-CC-YW-degly | MKNLDCWVDNEEDIDVILKKSTILNLDINNDIISDISGFNSSVITYPDAQLVPGINGKAIHL VNNESSEVIVHKAMDIEYNDMFNNFTVSFWLRVPKVSASHLEQYGTNEYSIISSMKKHSLSI GSGWSVSLKGNNLIWTLKDSAGEVRQITFRDLPDKFNAYLANKWVFITITNDRLSSANLYIN GVLMGSAEITGLGAIREDNNITLKLDRCNNNQYVSIDKFRIFCKALNPKEIEKLYTSYLSI TTTMLATRNFSGGKSGGNKKSDGVKESSESTNTTIEDEDmqiyegkltaeglrfgivasrfn halvdrlvegaidaivrhggreeditlvrvpgsweipvaagelarkeNiSaviaigvlirgL EVLFQGPGAKFVAAWTLKAAAGDEVDatphfdyiasevskgladlslelrkpitfgvitadt leqaieragtkhgnkgweaalsaiemanlfkslrGGKSGGNKKSDGVNLaDLGLTQSNIQKL DIDITEGDNAGVQITLTNDQALVKVGNFQTQGSVRDIENLRQTIEAQISDLDSQSNTSNAaQ VALERVRQLNNNIENLAGETTQAISIGDNANRaAQTLGKINAaFRNAIAQGAADDKASNIRL GSSLREIATGLASQSKNLNNQaLLSLSNTNIVQAGSGSARLLSLVNQPVQNAQALVSTGAQQ LIQARSMNSVETAYDSDEIRSRASTLNNVaNGLNTIASNFRNQVAGLDSRLTDVQALAADIK QLPNE |
| 103 | revTT-LS-PADRE-SaTyflagellin-CC-YW | MKNLDCWVDNEEDIDVILKKSTILNLDINNDIISDISGFNSSVITYPDAQLVPGINGKAIHL VNNESSEVIVHKAMDIEYNDMFNNFTVSFWLRVPKVSASHLEQYGTNEYSIISSMKKHSLSI GSGWSVSLKGNNLIWTLKDSAGEVRQITFRDLPDKFNAYLANKWVFITITNDRLSSANLYIN GVLMGSAEITGLGAIREDNNITLKLDRCNNNQYVSIDKFRIFCKALNPKEIEKLYTSYLSI TTTMLATRNFSGGKSGGNKKSDGVKESSESTNTTIEDEDmqiyegkltaeglrfgivasrfn halvdrlvegaidaivrhggreeditlvrvypgsweipvaagelarkeNiSaviaigvlirgL EVLFQGPGAKFVAAWTLKAAAGDEVDatphfdyiasevskgladlslelrkpitfgvitadt leqaieragtkhgnkgweaalsaiemanlfkslrGGKSGGNKKSDGVENPLQKIDAALAQVD TLRSDLGAVQNRFNSAITNLGNTVNNLTSARSRIEDSDYATEVSNMSRAQILQQAGTSVLAQ ANQVPQNVLSLLRGSGSAAQVINTNSLSLLTQNNLNKSQSALGTAIERLSSGLRINSAKDDA AGQAIANRFTANIKGLTQASRNANDGISIAQTTEGALNEINNNLQRVRELAVQSANSTNSQS DLDSIQAEITQRLNEIDRVSGQTQFNGVKVLAQDNTLTIQVGANDGETIDIDLKQINSQTLG LDTLN |
| 104 | revTT-LS-PADRE-SaTyflagellin-CC-YW-degly | MKNLDCWVDNEEDIDVILKKSTILNLDINNDIISDISGFNSSVITYPDAQLVPGINGKAIHL VNNESSEVIVHKAMDIEYNDMFNNFTVSFWLRVPKVSASHLEQYGTNEYSIISSMKKHSLSI GSGWSVSLKGNNLIWTLKDSAGEVRQITFRDLPDKFNAYLANKWVFITITNDRLSSANLYIN GVLMGSAEITGLGAIREDNNITLKLDRCNNNQYVSIDKFRIFCKALNPKEIEKLYTSYLSI TTTMLATRNFSGGKSGGNKKSDGVKESSESTNTTIEDEDgsgmqiyegkltaeglrfgivas rfnhalvdrlvegaidaivrhggreeditlvrvpgsweipvaagelarkeNiSaviaigvli rgLEVLFQGPGAKFVAAWTLKAAAGDEVDatphfdyiasevskgladlslelrkpitfgvit adtleqaieragtkhgnkgweaalsaiemanlfkslrGGKSGGNKKSDGVENPLQKIDAALA QVDTLRSDLGAVQNRFNSAITNLGNTVNNLaSARSRIEDSDYATEVSNMaRAQILQQAGTSV LAQANQVPQNVLSLLRGSGSAAQVINTNSLSLLTQNNLNKaQSALGTAIERLSSGLRINSAK DDAAGQAIANRFTANIKGLTQASRNANDGISIAQTTEGALNEINNNLQRVRELAVQSANSaN SQSDLDSIQAEITQRLNEIDRVSGQTQFNGVKVLAQDNTLTIQVGANDGETIDIDLKQINSQ TLGLDTLN |
| 105 | SaTyflagellin-LS-PADRE-rTT-His-CC-YW | NLTDLGLTQSNIQKLDIDITEGDNAGVQITLTNDQALVKVGNFQTQGSVRDIENLRQTIEAQ ISDLDSQSNTSNASQVALERVRQLNNNIENLAGETTQAISIGDNANRSAQTLGKINATFRNA IAQGAADDKASNIRLGSSLREIATGLASQSKNLNNQTLLSLSNTNIVQAGSGSARLLSLVNQ PVQNAQALVSTGAQQLIQARSMNSVETAYDSDEIRSRASTLNNVTNGLNTIASNFRNQVAGL DSRLTDVQALAADIKQLPNEGGKSGGNKKSDGVmqiyegkltaeglrfgivasrfnhalvdr lvegaidaivrhggreeditlvrvpgsweipvaagelarkeNiSaviaigvlirgLEVLFQG |

TABLE 1-continued

Exemplary sequences of fusion proteins containing a protein nanoparticle subunit fused to a heterologous carrier protein and optionally a heterologous T-cell helper epitope.

| SEQ ID NO | Name | Sequence |
|---|---|---|
| | | PGAKFVAAWTLKAAAGDEVDatphfdyiasevskgladlslelrkpitfgvitadtleqaie ragtkhgnkgweaalsaiemanlfkslrTTMLATRNFSGGKSGGNKKSDGVKESSESTNTTI EDEDMKNLDCWVDNEEDIDVILKKSTILNLDINNDIISDISGFNSSVITYPDAQLVPGINGK AIHLVNNESSEVIVHKAMDIEYNDMFNNFTVSFWLRVPKVSASHLEQYGTNEYSIISSMKKH SLSIGSGWSVSLKGNNLIWTLKDSAGEVRQITFRDLPDKFNAYLANKWVFITITNDRLSSAN LYINGVLMGSAEITGLGAIREDNNITLKLDRCNNNNQYVSIDKFRIFCKALNPKEIEKLYTS YLSIT |
| 106 | SaTyflagellin-<br>LS-<br>PADRE-<br>rTT-His-<br>CC-YW-<br>degly | NLaDLGLTQSNIQKLDIDITEGDNAGVQITLTNDQALVKVGNFQTQGSVRDIENLRQTIEAQ ISDLDSQSNTSNAaQVALERVRQLNNNIENLAGETTQAISIGDNANRaAQTLGKINAaFRNA IAQGAADDKASNIRLGSSLREIATGLASQSKNLNNQaLLSLSNTNIVQAGSGSARLLSLVNQ PVQNAQALVSTGAQQLIQARSMNSVETAYDSDEIRSRASTLNNVaNGLNTIASNFRNQVAGL DSRLTDVQALAADIKQLPNEGGKSGGNKKSDGVgsgmqiyegkltaeglrfgivasrfnhal vdrlvegaidaivrhggreeditlvrvpgsweipvaagelarkeNiSaviaigvlirgLEVL FQGPGPGAKFVAAWTLKAAAGDEVDatphfdyiasevskgladlslelrkpitfgvitadtleq aieragtkhgnkgweaalsaiemanlfkslrTTMLATRNFSGGKSGGNKKSDGVKESSESTN TTIEDEDMKNLDCWVDNEEDIDVILKKSTILNLDINNDIISDISGFNSSVITYPDAQLVPGI NGKAIHLVNNESSEVIVHKAMDIEYNDMFNNFTVSFWLRVPKVSASHLEQYGTNEYSIISSM KKHSLSIGSGWSVSLKGNNLIWTLKDSAGEVRQITFRDLPDKFNAYLANKWVFITITNDRLS SANLYINGVLMGSAEITGLGAIREDNNITLKLDRCNNNNQYVSIDKFRIFCKALNPKEIEKL YTSYLSIT |
| 107 | revSaTyflagel-<br>lin-<br>LS-PADRE-<br>rTT-His-<br>CC-YW | ENPLQKIDAALAQVDTLRSDLGAVQNRFNSAITNLGNTVNNLTSARSRIEDSDYATEVSNMS RAQILQQAGTSVLAQANQVPQNVLSLLRGSGSAAQVINTNSLSLLTQNNLNKSQSALGTAIE RLSSGLRINSAKDDAAGQAIANRFTANIKGLTQASRNANDGISIAQTTEGALNEINNNLQRV RELAVQSANSTNSQSDLDSIQAEITQRLNEIDRVSGQTQFNGVKVLAQDNTLTIQVGANDGE TIDIDLKQINSQTLGLDTLNGGKSGGNKKSDGVmqiyegkltaeglrfgivasrfnhalvdr lvegaidaivrhggreeditlvrvpgsweipvaagelarkeNiSaviaigvlirgLEVLFQG PGPGAKFVAAWTLKAAAGDEVDatphfdyiasevskgradlslelrkpitfgvitadtleqaie ragtkhgnkgweaalsaiemanlfkslrTTMLATRNFSGGKSGGNKKSDGVKESSESTNTTI EDEDMKNLDCWVDNEEDIDVILKKSTILNLDINNDIISDISGFNSSVITYPDAQLVPGINGK AIHLVNNESSEVIVHKAMDIEYNDMFNNFTVSFWLRVPKVSASHLEQYGTNEYSIISSMKKH SLSIGSGWSVSLKGNNLIWTLKDSAGEVRQITFRDLPDKFNAYLANKWVFITITNDRLSSAN LYINGVLMGSAEITGLGAIREDNNITLKLDRCNNNNQYVSIDKFRIFCKALNPKEIEKLYTS YLSIT |
| 108 | revSaTyflagel-<br>lin-<br>LS-PADRE-<br>rTT-His-<br>CC-YW-<br>degly | ENPLQKIDAALAQVDTLRSDLGAVQNRFNSAITNLGNTVNNLaSARSRIEDSDYATEVSNMa RAQILQQAGTSVLAQANQVPQNVLSLLRGSGSAAQVINTNSLSLLTQNNLNKaQSALGTAIE RLSSGLRINSAKDDAAGQAIANRFTANIKGLTQASRNANDGISIAQTTEGALNEINNNLQRV RELAVQSANSaNSQSDLDSIQAEITQRLNEIDRVSGQTQFNGVKVLAQDNTLTIQVGANDGE TIDIDLKQINSQTLGLDTLNGGKSGGNKKSDGVgsgmqiyegkltaeglrfgivasrfnhal vdrlvegaidaivrhggreeditlvrvpgsweipvaagelarkeNiSaviaigvlirgLEVL FQGPGPGAKFVAAWTLKAAAGDEVDatphfdyiasevskgladlslelrkpitfgvitadtleq aieragtkhgnkgweaalsaiemanlfkslrggTTMLATRNFSGGKSGGNKKSDGVKESSES TNTTIEDEDMKNLDCWVDNEEDIDVILKKSTILNLDINNDIISDISGFNSSVITYPDAQLVP GINGKAIHLVNNESSEVIVHKAMDIEYNDMFNNFTVSFWLRVPKVSASHLEQYGTNEYSIIS SMKKHSLSIGSGWSVSLKGNNLIWTLKDSAGEVRQITFRDLPDKFNAYLANKWVFITITNDR LSSANLYINGVLMGSAEITGLGAIREDNNITLKLDRCNNNNQYVSIDKFRIFCKALNPKEIE KLYTSYLSIT |
| 246 | LS-rTT-<br>degly | MQIYEGKLTAEGLRFGIVASRFNHALVDRLVEGCIDCIVRHGGREEDITLVRVPGSWEIPVA AGELARKEDIDAVIAIGVLIRGATPHFDYIASEVSKGLANLSLELRKPITFGVITADTLEQA IERAGTKHGNKCWEAALSAIEMANLFKSLRgsgsgsMKNLDCWVDNEEDIDVILKKSTILNL DINNDIISDISGFNSAVITYPDAQLVPGINGKAIHLVNNEASEVIVHKAMDIEYNDMFNNFT VSFWLRVPKVSASHLEQYGTNEYSIISSMKKHSLSIGSGWSVSLKGNNLIWTLKDSAGEVRQ ITFRDLPDKFNAYLANKWVFITITNDRLSSANLYINGVLMGSAEITGLGAIREDNQITLKLD RCNNNNQYVSIDKFRIFCKALNPKEIEKLYTSYLSITFLRDFWGNPLRYDTEYYLIPVASSS KDVQLKQITDYMYLTNAPSYTNGKLNIYYRRLYNGLKFIIKRYTPNNEIDSFVKSGDFIKLY VSYNNNEHIVGYPKDGNAFNNLDRILRVGYNAPGIPLYKKMEAVKLRDLKTYSVQLKLYDDK QASLGLVGTHNGQIGNDPNRDILIASNWYFNHLKDKILGCDWYFVPTDEGWTND |
| 247 | LS-<br>CRM197-<br>degly | MQIYEGKLTAEGLRFGIVASRFNHALVDRLVEGCIDCIVRHGGREEDITLVRVPGSWEIPVA AGELARKEDIDAVIAIGVLIRGATPHFDYIASEVSKGLANLSLELRKPITFGVITADTLEQA IERAGTKHGNKCWEAALSAIEMANLFKSLRgsgsgsDYKDDDDKgsgGADDVVDSSKSFVME NFASYHGTKPGYVDSIQKGIQKPKSGTQGNYDDDWKEFYSTDNKYDAAGYSVDNENPLSGKA GGVVKVTYPGLTKVLALKVDNAETIKKELGLSLTEPLMEQVGTEEFIKRFGDGASRVVLSLP FAEGSSSVEYINNWEQAKALSVELEINFETRKGRGQDAMYEYMAQACAGNRVRRSVGSSLSC INLDWDVIRDKTKTKIESLKEHGPIKNKMSESPNKAVSEEKAKQYLEEFHQTALEHPELSEL KTVTGTNPVFAGANYAAWAVNVAQVIDSETADNLEKTTAALSILPGIGSVMGIADGAVHHNT |

TABLE 1-continued

Exemplary sequences of fusion proteins containing a protein nanoparticle subunit fused to a heterologous carrier protein and optionally a heterologous T-cell helper epitope.

| SEQ ID NO | Name | Sequence |
|---|---|---|
| | | EEIVAQSIALSSLMVAQAIPLVGELVDIGFAAYNFVESIINLFQVVHNSYNRPAYSPGHKTQ PFLHDGYAVSWNTVEDSIIRTGFQGESGHDIKITAENTPLPIAGVLLPTIPGKLDVNKAKTH ISVNGRKIRMRCRAIDGDVTFCRPKSPVYVGNGVHANLHVAFHRSSSEKIHSNEISSDSIGV LGYQKTVDHTKVNSKLSLFFEIKS |
| 248 | LS-2xCRM197-degly | MQIYEGKLTAEGLRFGIVASRFNHALVDRLVEGCIDCIVRHGGREEDITLVRVPGSWEIPVA AGELARKEDIDAVIAIGVLIRGATPHFDYIASEVSKGLANLSLELRKPITFGVITADTLEQA IERAGTKHGNKCWEAALSAIEMANLFKSLRgsgDYKDDDDKgsgGADDVVDSSKSFVMENFA SYHGTKPGYVDSIQKGIQKPKSGTQGNYDDDWKEFYSTDNKYDAAGYSVDNENPLSGKAGGV VKVTYPGLTKVLALKVDNAETIKKELGLSLTEPLMEQVGTEEFIKRFGDGASRVVLSLPFAE GSSSVEYINNWEQAKALSVELEINFETRGKRGQDAMYEYMAQACAGNRVRRSVGSSLSCINL DWDVIRDKTKTKIESLKEHGPIKNKMSESPNKAVSEEKAKQYLEEFHQTALEHPELSELKTV TGTNPVFAGANYAAWAVNVAQVIDSETADNLEKTTAALSILPGIGSVMGIADGAVHHNTEEI VAQSIALSSLMVAQAIPLVGELVDIGFAAYNFVESIINLFQVVHNSYNRPAYSPGHKTQPFL HDGYAVSWNTVEDSIIRTGFQGESGHDIKITAENTPLPIAGVLLPTIPGKLDVNKAKTHISV NGRKIRMRCRAIDGDVTFCRPKSPVYVGNGVHANLHVAFHRSSSEKIHSNEISSDSIGVLGY QKTVDHTKVNSKLSLFFEIKSgggsgggsGADDVVDSSKSFVMENFASYHGTKPGYVDSIQK GIQKPKSGTQGNYDDDWKEFYSTDNKYDAAGYSVDNENPLSGKAGGVVKVTYPGLTKVLALK VDNAETIKKELGLSLTEPLMEQVGTEEFIKRFGDGASRVVLSLPFAEGSSSVEYINNWEQAK ALSVELEINFETRGKRGQDAMYEYMAQACAGNRVRRSVGSSLSCINLDWDVIRDKTKTKIES LKEHGPIKNKMSESPNKAVSEEKAKQYLEEFHQTALEHPELSELKTVTGTNPVFAGANYAAW AVNVAQVIDSETADNLEKTTAALSILPGIGSVMGIADGAVHHNTEEIVAQSIALSSLMVAQA IPLVGELVDIGFAAYNFVESIINLFQVVHNSYNRPAYSPGHKTQPFLHDGYAVSWNTVEDSI IRTGFQGESGHDIKITAENTPLPIAGVLLPTIPGKLDVNKAKTHISVNGRKIRMRCRAIDGD VTFCRPKSPVYVGNGVHANLHVAFHRSSSEKIHSNEISSDSIGVLGYQKTVDHTKVNSKLSL FFEIKS |
| 249 | LS-HID | MQIYEGKLTAEGLRFGIVASRFNHALVDRLVEGCIDCIVRHGGREEDITLVRVPGSWEIPVA AGELARKEDIDAVIAIGVLIRGATPHFDYIASEVSKGLANLSLELRKPITFGVITADTLEQA IERAGTKHGNKCWEAALSAIEMANLFKSLRgsgDYKDDDDKgsgsnmantqmksdkiiiahr gasgylpehtleskalafaqqadyleqdlamtkdgrlvvihdhfldgltdvakkfphrhrkd gryyvidftlkeiqslemtenfetkdgkqaqvypnrfplwkshfrihtfedeiefiqgleks tgkkvgiypeikapwfhhqngkdiaaetlkvlkkygydkktdmvylqtfdfnelkriktell pqmgmdlklvqliaytdwketqekdpkgywvnynydwmfkpgamaevvkyadgvgpgwymlv nkeeskpdnivytplvkelaqynvevhpytvrkdalpefftdvnqmydallnksgatgvftd fpdtgveflkgik |
| 250 | TThc-degly-LS | MKNLDCWVDNEEDIDVILKKSTILNLDINNDIISDISGFNSAVITYPDAQLVPGINGKAIHL VNNEASEVIVHKAMDIEYNDMFNNFTVSFWLRVPKVSASHLEQYGTNEYSIISSMKKHSLSI GSGWSVSLKGNNLIWTLKDSAGEVRQITFRDLPDKFNAYLANKWVFITITNDRLSSANLYIN GVLMGSAEITGLGAIREDNQITLKLDRCNNNNQYVSIDKFRIFCKALNPKEIEKLYTSYLSI TFLRDFWGNPLRYDTEYYLIPVASSSKDVQLKQITDYMYLTNAPSYTNGKLNIYYRRLYNGL KFIIKRYTPNNEIDSFVKSGDFIKLYVSYNNNEHIVGYPKDGNAFNNLDRILRVGYNAPGIP LYKKMEAVKLRDLKTYSVQLKLYDDKQASLGLVGTHNGQIGNDPNRDILIASNWYFNHLKDK ILGCDWYFVPTDEGWTNDgsgdykddddkgsgMQIYEGKLTAEGLRFGIVASRFNHALVDRL VEGCIDCIVRHGGREEDITLVRVPGSWEIPVAAGELARKEDIDAVIAIGVLIRGATPHFDYI ASEVSKGLANLSLELRKPITFGVITADTLEQAIERAGTKHGNKCWEAALSAIEMANLFKSLR gsgDYKDDDDKgsg |
| 251 | HID-LS | Snmantqmksdkiiiahrgasgylpehtleskalafaqqadyleqdlamtkdgrlvvihdhf ldgltdvakkfphrhrkdgryyvidftlkeigslemtenfetkdgkqaqvypnrfplwkshf rihtfedeiefiqglekstgkkvgiypeikapwfhhqngkdiaaetlkvlkkygydkktdmv ylqtfdfnelkriktellpqmgmdlklvqliaytdwketqekdpkgywvnynydwmfkpgam aevvkyadgvgpgwymlvnkeeskpdnivytplvkelaqynvevhpytvrkdalpefftdvn qmydallnksgatgvftdfpdtgveflkgikgsgdykddddkgsgMQIYEGKLTAEGLRFGI VASRFNHALVDRLVEGCIDCIVRHGGREEDITLVRVPGSWEIPVAAGELARKEDIDAVIAIG VLIRGATPHFDYIASEVSKGLANLSLELRKPITFGVITADTLEQAIERAGTKHGNKCWEAAL SAIEMANLFKSLR |
| 252 | CRM197-degly-LS | GADDVVDSSKSFVMENFASYHGTKPGYVDSIQKGIQKPKSGTQGNYDDDWKEFYSTDNKYDA AGYSVDNENPLSGKAGGVVKVTYPGLTKVLALKVDNAETIKKELGLSLTEPLMEQVGTEEFI KRFGDGASRVVLSLPFAEGSSSVEYINNWEQAKALSVELEINFETRGKRGQDAMYEYMAQAC AGNRVRRSVGSSLSCINLDWDVIRDKTKTKIESLKEHGPIKNKMSESPNKAVSEEKAKQYLE EFHQTALEHPELSELKTVTGTNPVFAGANYAAWAVNVAQVIDSETADNLEKTTAALSILPGI GSVMGIADGAVHHNTEEIVAQSIALSSLMVAQAIPLVGELVDIGFAAYNFVESIINLFQVVH NSYNRPAYSPGHKTQPFLHDGYAVSWNTVEDSIIRTGFQGESGHDIKITAENTPLPIAGVLL PTIPGKLDVNKAKTHISVNGRKIRMRCRAIDGDVTFCRPKSPVYVGNGVHANLHVAFHRSSS EKIHSNEISSDSIGVLGYQKTVDHTKVNSKLSLFFEIKSgsgdykddddkgsgMQIYEGKLT AEGLRFGIVASRFNHALVDRLVEGCIDCIVRHGGREEDITLVRVPGSWEIPVAAGELARKED IDAVIAIGVLIRGATPHFDYIASEVSKGLANLSLELRKPITFGVITADTLEQAIERAGTKHG NKCWEAALSAIEMANLFKSLR |
| 253 | 2xCRM197-degly-LS | GADDVVDSSKSFVMENFASYHGTKPGYVDSIQKGIQKPKSGTQGNYDDDWKEFYSTDNKYDA AGYSVDNENPLSGKAGGVVKVTYPGLTKVLALKVDNAETIKKELGLSLTEPLMEQVGTEEFI |

TABLE 1-continued

Exemplary sequences of fusion proteins containing a protein nanoparticle subunit fused to a heterologous carrier protein and optionally a heterologous T-cell helper epitope.

| SEQ ID NO | Name | Sequence |
|---|---|---|
| | | KRFGDGASRVVLSLPFAEGSSSVEYINNWEQAKALSVELEINFETRGKRGQDAMYEYMAQAC<br>AGNRVRRSVGSSLSCINLDWDVIRDKTKTKIESLKEHGPIKNKMSESPNKAVSEEKAKQYLE<br>EFHQTALEHPELSELKTVTGTNPVFAGANYAAWAVNVAQVIDSETADNLEKTTAALSILPGI<br>GSVMGIADGAVHHNTEEIVAQSIALSSLMVAQAIPLVGELVDIGFAAYNFVESIINLFQVVH<br>NSYNRPAYSPGHKTQPFLHDGYAVSWNTVEDSIIRTGFQGESGHDIKITAENTPLPIAGVLL<br>PTIPGKLDVNKAKTHISVNGRKIRMRCRAIDGDVTFCRPKSPVYVGNGVHANLHVAFHRSSS<br>EKIHSNEISSDSIGVLGYQKTVDHTKVNSKLSLFFEIKSgggsgggsGADDVVDSSKSFVME<br>NFASYHGTKPGYVDSIQKGIQKPKSGTQGNYDDDWKEFYSTDNKYDAAGYSVDNENPLSGKA<br>GGVVKVTYPGLTKVLALKVDNAETIKKELGLSLTEPLMEQVGTEEFIKRFGDGASRVVLSLP<br>FAEGSSSVEYINNWEQAKALSVELEINFETRGKRGQDAMYEYMAQACAGNRVRRSVGSSLSC<br>INLDWDVIRDKTKTKIESLKEHGPIKNKMSESPNKAVSEEKAKQYLEEFHQTALEHPELSEL<br>KTVTGTNPVFAGANYAAWAVNVAQVIDSETADNLEKTTAALSILPGIGSVMGIADGAVHHNT<br>EEIVAQSIALSSLMVAQAIPLVGELVDIGFAAYNFVESIINLFQVVHNSYNRPAYSPGHKTQ<br>PFLHDGYAVSWNTVEDSIIRTGFQGESGHDIKITAENTPLPIAGVLLPTIPGKLDVNKAKTH<br>ISVNGRKIRMRCRAIDGDVTFCRPKSPVYVGNGVHANLHVAFHRSSSEKIHSNEISSDSIGV<br>LGYQKTVDHTKVNSKLSLFFEIKSgsgdykddddkgsgMQIYEGKLTAEGLRFGIVASRFNH<br>ALVDRLVEGCIDCIVRHGGREEDITLVRVPGSWEIPVAAGELARKEDIDAVIAIGVLIRGAT<br>PHFDYIASEVSKGLANLSLELRKPITFGVITADTLEQAIERAGTKHGNKCWEAALSAIEMAN<br>LFKSLR |
| 331 | LS K7C-<br>R40C<br>caIgG2a-<br>rTT | QIYEGcLTAEGLRFGIVASRFNHALVDRLVEGAIDAIVcHGGREEDITLVRVPGSWEIPVAA<br>GELARKEnIsAVIAIGVLIRGATPHFDYIASEVSKGLADLSLELRKPITFGVITADTLEQAI<br>ERAGTKHGNKGWEAALSAIEMANLFKSLRgsgGSEPKIPQPQPKPQPQPQPQPKPQPKPEPE<br>gsgMKNLDCWVDNEEDIDVILKKSTILNLDINNDIISDISGFNSSVITYPDAQLVPGINGKA<br>IHLVNNESSEVIVHKAMDIEYNDMFNNFTVSFWLRVPKVSASHLEQYGTNEYSIISSMKKHS<br>LSIGSGWSVSLKGNNLIWTLKDSAGEVRQITFRDLPDKFNAYLANKWVFITITNDRLSSANL<br>YINGVLMGSAEITGLGAIREDNNITLKLDRCNNNNQYVSIDKFRIFCKALNPKEIEKLYTSY<br>LSITFLRDFWGNPLRYDTEYYLIPVASSSKDVQLKNITDYMYLTNAPSYTNGKLNIYYRRLY<br>NGLKFIIKRYTPNNEIDSFVKSGDFIKLYVSYNNNEHIVGYPKDGNAFNNLDRILRVGYNAP<br>GIPLYKKMEAVKLRDLKTYSVQLKLYDDKNASLGLVGTHNGQIGNDPNRDILIASNWYFNHL<br>KDKILGCDWYFVPTDEGWTND |
| 332 | LS-L121C-<br>K131C-<br>caIgG2a-<br>rTT | QIYEGKLTAEGLRFGIVASRFNHALVDRLVEGAIDAIVRHGGREEDITLVRVPGSWEIPVAA<br>GELARKEnIsAVIAIGVLIRGATPHFDYIASEVSKGLADLSLELRKPITFGVITADTcEQAI<br>ERAGTcHGNKGWEAALSAIEMANLFKSLRgsgGSEPKIPQPQPKPQPQPQPQPKPQPKPEPE<br>gsgMKNLDCWVDNEEDIDVILKKSTILNLDINNDIISDISGFNSSVITYPDAQLVPGINGKA<br>IHLVNNESSEVIVHKAMDIEYNDMFNNFTVSFWLRVPKVSASHLEQYGTNEYSIISSMKKHS<br>LSIGSGWSVSLKGNNLIWTLKDSAGEVRQITFRDLPDKFNAYLANKWVFITITNDRLSSANL<br>YINGVLMGSAEITGLGAIREDNNITLKLDRCNNNNQYVSIDKFRIFCKALNPKEIEKLYTSY<br>LSITFLRDFWGNPLRYDTEYYLIPVASSSKDVQLKNITDYMYLTNAPSYTNGKLNIYYRRLY<br>NGLKFIIKRYTPNNEIDSFVKSGDFIKLYVSYNNNEHIVGYPKDGNAFNNLDRILRVGYNAP<br>GIPLYKKMEAVKLRDLKTYSVQLKLYDDKNASLGLVGTHNGQIGNDPNRDILIASNWYFNHL<br>KDKILGCDWYFVPTDEGWTND |
| 333 | LS-L121C-<br>K131CG<br>caIgG2a-<br>rTT | QIYEGKLTAEGLRFGIVASRFNHALVDRLVEGAIDAIVRHGGREEDITLVRVPGSWEIPVAA<br>GELARKEnIsAVIAIGVLIRGATPHFDYIASEVSKGLADLSLELRKPITFGVITADTcEQAI<br>ERAGTcgHGNKGWEAALSAIEMANLFKSLRgsgGSEPKIPQPQPKPQPQPQPQPKPQPKPEP<br>EgsgMKNLDCWVDNEEDIDVILKKSTILNLDINNDIISDISGFNSSVITYPDAQLVPGINGK<br>AIHLVNNESSEVIVHKAMDIEYNDMFNNFTVSFWLRVPKVSASHLEQYGTNEYSIISSMKKH<br>SLSIGSGWSVSLKGNNLIWTLKDSAGEVRQITFRDLPDKFNAYLANKWVFITITNDRLSSAN<br>LYINGVLMGSAEITGLGAIREDNNITLKLDRCNNNNQYVSIDKFRIFCKALNPKEIEKLYTS<br>YLSITFLRDFWGNPLRYDTEYYLIPVASSSKDVQLKNITDYMYLTNAPSYTNGKLNIYYRRL<br>YNGLKFIIKRYTPNNEIDSFVKSGDFIKLYVSYNNNEHIVGYPKDGNAFNNLDRILRVGYNA<br>PGIPLYKKMEAVKLRDLKTYSVQLKLYDDKNASLGLVGTHNGQIGNDPNRDILIASNWYFNH<br>LKDKILGCDWYFVPTDEGWTND |
| 334 | LS-L121C-<br>K131GC<br>caIgG2a-<br>rTT | QIYEGKLTAEGLRFGIVASRFNHALVDRLVEGAIDAIVRHGGREEDITLVRVPGSWEIPVAA<br>GELARKEnIsAVIAIGVLIRGATPHFDYIASEVSKGLADLSLELRKPITFGVITADTcEQAI<br>ERAGTgcHGNKGWEAALSAIEMANLFKSLRgsgGSEPKIPQPQPKPQPQPQPQPKPQPKPEP<br>EgsgMKNLDCWVDNEEDIDVILKKSTILNLDINNDIISDISGFNSSVITYPDAQLVPGINGK<br>AIHLVNNESSEVIVHKAMDIEYNDMFNNFTVSFWLRVPKVSASHLEQYGTNEYSIISSMKKH<br>SLSIGSGWSVSLKGNNLIWTLKDSAGEVRQITFRDLPDKFNAYLANKWVFITITNDRLSSAN<br>LYINGVLMGSAEITGLGAIREDNNITLKLDRCNNNNQYVSIDKFRIFCKALNPKEIEKLYTS<br>YLSITFLRDFWGNPLRYDTEYYLIPVASSSKDVQLKNITDYMYLTNAPSYTNGKLNIYYRRL<br>YNGLKFIIKRYTPNNEIDSFVKSGDFIKLYVSYNNNEHIVGYPKDGNAFNNLDRILRVGYNA<br>PGIPLYKKMEAVKLRDLKTYSVQLKLYDDKNASLGLVGTHNGQIGNDPNRDILIASNWYFNH<br>LKDKILGCDWYFVPTDEGWTND |
| 335 | LS-<br>L121CG-<br>K131C<br>caIgG2a-<br>rTT | QIYEGKLTAEGLRFGIVASRFNHALVDRLVEGAIDAIVRHGGREEDITLVRVPGSWEIPVAA<br>GELARKEnIsAVIAIGVLIRGATPHFDYIASEVSKGLADLSLELRKPITFGVITADTcgEQA<br>IERAGTcHGNKGWEAALSAIEMANLFKSLRgsgGSEPKIPQPQPKPQPQPQPQPKPQPKPEP<br>EgsgMKNLDCWVDNEEDIDVILKKSTILNLDINNDIISDISGFNSSVITYPDAQLVPGINGK<br>AIHLVNNESSEVIVHKAMDIEYNDMFNNFTVSFWLRVPKVSASHLEQYGTNEYSIISSMKKH<br>SLSIGSGWSVSLKGNNLIWTLKDSAGEVRQITFRDLPDKFNAYLANKWVFITITNDRLSSAN |

TABLE 1-continued

Exemplary sequences of fusion proteins containing a protein nanoparticle subunit fused to a heterologous carrier protein and optionally a heterologous T-cell helper epitope.

| SEQ ID NO | Name | Sequence |
|---|---|---|
| | | LYINGVLMGSAEITGLGAIREDNNITLKLDRCNNNQYVSIDKFRIFCKALNPKEIEKLYTS YLSITFLRDFWGNPLRYDTEYYLIPVASSSKDVQLKNITDYMYLTNAPSYTNGKLNIYYRRL YNGLKFIIKRYTPNNEIDSFVKSGDFIKLYVSYNNNEHIVGYPKDGNAFNNLDRILRVGYNA PGIPLYKKMEAVKLRDLKTYSVQLKLYDDKNASLGLVGTHNGQIGNDPNRDILIASNWYFNH LKDKILGCDWYFVPTDEGWTND |
| 336 | LS-L121GC-K131C caIgG2a-rTT | QIYEGKLTAEGLRFGIVASRFNHALVDRLVEGAIDAIVRHGGREEDITLVRVPGSWEIPVAA GELARKEnIsAVIAIGVLIRGATPHFDYIASEVSKGLADLSLELRKPITFGVITADTgcEQA IERAGTcHGNKGWEAALSAIEMANLFKSLRgsgGSEPKIPQPQPKPQPQPQPQPKPQPKPEP EgsgMKNLDCWVDNEEDIDVILKKSTILNLDINNDIISDISGFNSSVITYPDAQLVPGINGK AIHLVNNESSEVIVHKAMDIEYNDMFNNFTVSFWLRVPKVSASHLEQYGTNEYSIISSMKKH SLSIGSGWSVSLKGNNLIWTLKDSAGEVRQITFRDLPDKFNAYLANKWVFITITNDRLSSAN LYINGVLMGSAEITGLGAIREDNNITLKLDRCNNNQYVSIDKFRIFCKALNPKEIEKLYTS YLSITFLRDFWGNPLRYDTEYYLIPVASSSKDVQLKNITDYMYLTNAPSYTNGKLNIYYRRL YNGLKFIIKRYTPNNEIDSFVKSGDFIKLYVSYNNNEHIVGYPKDGNAFNNLDRILRVGYNA PGIPLYKKMEAVKLRDLKTYSVQLKLYDDKNASLGLVGTHNGQIGNDPNRDILIASNWYFNH LKDKILGCDWYFVPTDEGWTND |
| 337 | LS K7C-R40C CD8v1-rTT | QIYEGcLTAEGLRFGIVASRFNHALVDRLVEGAIDAIVcHGGREEDITLVRVPGSWEIPVAA GELARKEnIsAVIAIGVLIRGATPHFDYIASEVSKGLADLSLELRKPITFGVITADTLEQAI ERAGTKHGNKGWEAALSAIEMANLFKSLRgsgKPTTTPAPRPPTPAPTIASQPLSLRPEAtR PAAGGAVHTRGgsgMKNLDCWVDNEEDIDVILKKSTILNLDINNDIISDISGFNSSVITYPD AQLVPGINGKAIHLVNNESSEVIVHKAMDIEYNDMFNNFTVSFWLRVPKVSASHLEQYGTNE YSIISSMKKHSLSIGSGWSVSLKGNNLIWTLKDSAGEVRQITFRDLPDKFNAYLANKWVFIT ITNDRLSSANLYINGVLMGSAEITGLGAIREDNNITLKLDRCNNNQYVSIDKFRIFCKALN PKEIEKLYTSYLSITFLRDFWGNPLRYDTEYYLIPVASSSKDVQLKNITDYMYLTNAPSYTN GKLNIYYRRLYNGLKFIIKRYTPNNEIDSFVKSGDFIKLYVSYNNNEHIVGYPKDGNAFNNL DRILRVGYNAPGIPLYKKMEAVKLRDLKTYSVQLKLYDDKNASLGLVGTHNGQIGNDPNRDI LIASNWYFNHLKDKILGCDWYFVPTDEGWTND |
| 338 | LS-L121C-K131C-CD8v1-rTT | QIYEGKLTAEGLRFGIVASRFNHALVDRLVEGAIDAIVRHGGREEDITLVRVPGSWEIPVAA GELARKEnIsAVIAIGVLIRGATPHFDYIASEVSKGLADLSLELRKPITFGVITADTcEQAI ERAGTcHGNKGWEAALSAIEMANLFKSLRgsgKPTTTPAPRPPTPAPTIASQPLSLRPEAtR PAAGGAVHTRGgsgMKNLDCWVDNEEDIDVILKKSTILNLDINNDIISDISGFNSSVITYPD AQLVPGINGKAIHLVNNESSEVIVHKAMDIEYNDMFNNFTVSFWLRVPKVSASHLEQYGTNE YSIISSMKKHSLSIGSGWSVSLKGNNLIWTLKDSAGEVRQITFRDLPDKFNAYLANKWVFIT ITNDRLSSANLYINGVLMGSAEITGLGAIREDNNITLKLDRCNNNQYVSIDKFRIFCKALN PKEIEKLYTSYLSITFLRDFWGNPLRYDTEYYLIPVASSSKDVQLKNITDYMYLTNAPSYTN GKLNIYYRRLYNGLKFIIKRYTPNNEIDSFVKSGDFIKLYVSYNNNEHIVGYPKDGNAFNNL DRILRVGYNAPGIPLYKKMEAVKLRDLKTYSVQLKLYDDKNASLGLVGTHNGQIGNDPNRDI LIASNWYFNHLKDKILGCDWYFVPTDEGWTND |
| 339 | LS-L121C-K131CG CD8v1-rTT | QIYEGKLTAEGLRFGIVASRFNHALVDRLVEGAIDAIVRHGGREEDITLVRVPGSWEIPVAA GELARKEnIsAVIAIGVLIRGATPHFDYIASEVSKGLADLSLELRKPITFGVITADTcEQAI ERAGTcgHGNKGWEAALSAIEMANLFKSLRgsgKPTTTPAPRPPTPAPTIASQPLSLRPEAt RPAAGGAVHTRGgsgMKNLDCWVDNEEDIDVILKKSTILNLDINNDIISDISGFNSSVITYP DAQLVPGINGKAIHLVNNESSEVIVHKAMDIEYNDMFNNFTVSFWLRVPKVSASHLEQYGTN EYSIISSMKKHSLSIGSGWSVSLKGNNLIWTLKDSAGEVRQITFRDLPDKFNAYLANKWVFI TITNDRLSSANLYINGVLMGSAEITGLGAIREDNNITLKLDRCNNNQYVSIDKFRIFCKAL NPKEIEKLYTSYLSITFLRDFWGNPLRYDTEYYLIPVASSSKDVQLKNITDYMYLTNAPSYT NGKLNIYYRRLYNGLKFIIKRYTPNNEIDSFVKSGDFIKLYVSYNNNEHIVGYPKDGNAFNN LDRILRVGYNAPGIPLYKKMEAVKLRDLKTYSVQLKLYDDKNASLGLVGTHNGQIGNDPNRD ILIASNWYFNHLKDKILGCDWYFVPTDEGWTND |
| 340 | LS-L121C-K131GC CD8v1-rTT | QIYEGKLTAEGLRFGIVASRFNHALVDRLVEGAIDAIVRHGGREEDITLVRVPGSWEIPVAA GELARKEnIsAVIAIGVLIRGATPHFDYIASEVSKGLADLSLELRKPITFGVITADTcEQAI ERAGTgcHGNKGWEAALSAIEMANLFKSLRgsgKPTTTPAPRPPTPAPTIASQPLSLRPEAt RPAAGGAVHTRGgsgMKNLDCWVDNEEDIDVILKKSTILNLDINNDIISDISGFNSSVITYP DAQLVPGINGKAIHLVNNESSEVIVHKAMDIEYNDMFNNFTVSFWLRVPKVSASHLEQYGTN EYSIISSMKKHSLSIGSGWSVSLKGNNLIWTLKDSAGEVRQITFRDLPDKFNAYLANKWVFI TITNDRLSSANLYINGVLMGSAEITGLGAIREDNNITLKLDRCNNNQYVSIDKFRIFCKAL NPKEIEKLYTSYLSITFLRDFWGNPLRYDTEYYLIPVASSSKDVQLKNITDYMYLTNAPSYT NGKLNIYYRRLYNGLKFIIKRYTPNNEIDSFVKSGDFIKLYVSYNNNEHIVGYPKDGNAFNN LDRILRVGYNAPGIPLYKKMEAVKLRDLKTYSVQLKLYDDKNASLGLVGTHNGQIGNDPNRD ILIASNWYFNHLKDKILGCDWYFVPTDEGWTND |
| 341 | LS-L121CG-K131C CD8v1-rTT | QIYEGKLTAEGLRFGIVASRFNHALVDRLVEGAIDAIVRHGGREEDITLVRVPGSWEIPVAA GELARKEnIsAVIAIGVLIRGATPHFDYIASEVSKGLADLSLELRKPITFGVITADTcgEQA IERAGTcHGNKGWEAALSAIEMANLFKSLRgsgKPTTTPAPRPPTPAPTIASQPLSLRPEAt RPAAGGAVHTRGgsgMKNLDCWVDNEEDIDVILKKSTILNLDINNDIISDISGFNSSVITYP DAQLVPGINGKAIHLVNNESSEVIVHKAMDIEYNDMFNNFTVSFWLRVPKVSASHLEQYGTN EYSIISSMKKHSLSIGSGWSVSLKGNNLIWTLKDSAGEVRQITFRDLPDKFNAYLANKWVFI TITNDRLSSANLYINGVLMGSAEITGLGAIREDNNITLKLDRCNNNQYVSIDKFRIFCKAL NPKEIEKLYTSYLSITFLRDFWGNPLRYDTEYYLIPVASSSKDVQLKNITDYMYLTNAPSYT |

TABLE 1-continued

Exemplary sequences of fusion proteins containing a protein nanoparticle subunit fused to a heterologous carrier protein and optionally a heterologous T-cell helper epitope.

| SEQ ID NO | Name | Sequence |
|---|---|---|
| | | NGKLNIYYRRLYNGLKFIIKRYTPNNEIDSFVKSGDFIKLYVSYNNNEHIVGYPKDGNAFNN LDRILRVGYNAPGIPLYKKMEAVKLRDLKTYSVQLKLYDDKNASLGLVGTHNGQIGNDPNRD ILIASNWYFNHLKDKILGCDWYFVPTDEGWTND |
| 342 | LS-L121GC-K131C CD8v1-rTT | QIYEGKLTAEGLRFGIVASRFNHALVDRLVEGAIDAIVRHGGREEDITLVRVPGSWEIPVAA GELARKEnIsAVIAIGVLIRGATPHFDYIASEVSKGLADLSLELRKPITFGVITADTgcEQA IERAGTcHGNKGWEAALSAIEMANLFKSLRgsgKPTTTPAPRPPTPAPTIASQPLSLRPEAt RPAAGGAVHTRGgsgMKNLDCWVDNEEDIDVILKKSTILNLDINNDIISDISGFNSSVITYP DAQLVPGINGKAIHLVNNESSEVIVHKAMDIEYNDMFNNFTVSFWLRVPKVSASHLEQYGTN EYSIISSMKKHSLSIGSGWSVSLKGNNLIWTLKDSAGEVRQITFRDLPDKFNAYLANKWVFI TITNDRLSSANLYINGVLMGSAEITGLGAIREDNNITLKLDRCNNNNQYVSIDKFRIFCKAL NPKEIEKLYTSYLSITFLRDFWGNPLRYDTEYYLIPVASSSKDVQLKNITDYMYLTNAPSYT NGKLNIYYRRLYNGLKFIIKRYTPNNEIDSFVKSGDFIKLYVSYNNNEHIVGYPKDGNAFNN LDRILRVGYNAPGIPLYKKMEAVKLRDLKTYSVQLKLYDDKNASLGLVGTHNGQIGNDPNRD ILIASNWYFNHLKDKILGCDWYFVPTDEGWTND |
| 343 | LS K7C-R40C C08-rTT | QIYEGcLTAEGLRFGIVASRFNHALVDRLVEGAIDAIVcHGGREEDITLVRVPGSWEIPVAA GELARKEnIsAVIAIGVLIRGATPHFDYIASEVSKGLADLSLELRKPITFGVITADTLEQAI ERAGTKHGNKGWEAALSAIEMANLFKSLRgsgKPTTTPAPRPPTPAPTIASQPLSLRPEACR PAAGGAVHTRGLDFACDgsgMKNLDCWVDNEEDIDVILKKSTILNLDINNDIISDISGFNSS VITYPDAQLVPGINGKAIHLVNNESSEVIVHKAMDIEYNDMFNNFTVSFWLRVPKVSASHLE QYGTNEYSIISSMKKHSLSIGSGWSVSLKGNNLIWTLKDSAGEVRQITFRDLPDKFNAYLAN KWVFITITNDRLSSANLYINGVLMGSAEITGLGAIREDNNITLKLDRCNNNNQYVSIDKFRI FCKALNPKEIEKLYTSYLSITFLRDFWGNPLRYDTEYYLIPVASSSKDVQLKNITDYMYLTN APSYTNGKLNIYYRRLYNGLKFIIKRYTPNNEIDSFVKSGDFIKLYVSYNNNEHIVGYPKDG NAFNNLDRILRVGYNAPGIPLYKKMEAVKLRDLKTYSVQLKLYDDKNASLGLVGTHNGQIGN DPNRDILIASNWYFNHLKDKILGCDWYFVPTDEGWTND |
| 344 | LS-L121C-K131C-CD8-rTT | QIYEGKLTAEGLRFGIVASRFNHALVDRLVEGAIDAIVRHGGREEDITLVRVPGSWEIPVAA GELARKEnIsAVIAIGVLIRGATPHFDYIASEVSKGLADLSLELRKPITFGVITADTcEQAI ERAGTcHGNKGWEAALSAIEMANLFKSLRgsgKPTTTPAPRPPTPAPTIASQPLSLRPEACR PAAGGAVHTRGLDFACDgsgMKNLDCWVDNEEDIDVILKKSTILNLDINNDIISDISGFNSS VITYPDAQLVPGINGKAIHLVNNESSEVIVHKAMDIEYNDMFNNFTVSFWLRVPKVSASHLE QYGTNEYSIISSMKKHSLSIGSGWSVSLKGNNLIWTLKDSAGEVRQITFRDLPDKFNAYLAN KWVFITITNDRLSSANLYINGVLMGSAEITGLGAIREDNNITLKLDRCNNNNQYVSIDKFRI FCKALNPKEIEKLYTSYLSITFLRDFWGNPLRYDTEYYLIPVASSSKDVQLKNITDYMYLTN APSYTNGKLNIYYRRLYNGLKFIIKRYTPNNEIDSFVKSGDFIKLYVSYNNNEHIVGYPKDG NAFNNLDRILRVGYNAPGIPLYKKMEAVKLRDLKTYSVQLKLYDDKNASLGLVGTHNGQIGN DPNRDILIASNWYFNHLKDKILGCDWYFVPTDEGWTND |
| 345 | LS-L121C-K131CG CD8-rTT | QIYEGKLTAEGLRFGIVASRFNHALVDRLVEGAIDAIVRHGGREEDITLVRVPGSWEIPVAA GELARKEnIsAVIAIGVLIRGATPHFDYIASEVSKGLADLSLELRKPITFGVITADTcEQAI ERAGTcgHGNKGWEAALSAIEMANLFKSLRgsgKPTTTPAPRPPTPAPTIASQPLSLRPEAC RPAAGGAVHTRGLDFACDgsgMKNLDCWVDNEEDIDVILKKSTILNLDINNDIISDISGFNS SVITYPDAQLVPGINGKAIHLVNNESSEVIVHKAMDIEYNDMFNNFTVSFWLRVPKVSASHL EQYGTNEYSIISSMKKHSLSIGSGWSVSLKGNNLIWTLKDSAGEVRQITFRDLPDKFNAYLA NKWVFITITNDRLSSANLYINGVLMGSAEITGLGAIREDNNITLKLDRCNNNNQYVSIDKFR IFCKALNPKEIEKLYTSYLSITFLRDFWGNPLRYDTEYYLIPVASSSKDVQLKNITDYMYLT NAPSYTNGKLNIYYRRLYNGLKFIIKRYTPNNEIDSFVKSGDFIKLYVSYNNNEHIVGYPKD GNAFNNLDRILRVGYNAPGIPLYKKMEAVKLRDLKTYSVQLKLYDDKNASLGLVGTHNGQIG NDPNRDILIASNWYFNHLKDKILGCDWYFVPTDEGWTND |
| 346 | LS-L121C-K131GC CD8-rTT | QIYEGKLTAEGLRFGIVASRFNHALVDRLVEGAIDAIVRHGGREEDITLVRVPGSWEIPVAA GELARKEnIsAVIAIGVLIRGATPHFDYIASEVSKGLADLSLELRKPITFGVITADTcEQAI ERAGTgcHGNKGWEAALSAIEMANLFKSLRgsgKPTTTPAPRPPTPAPTIASQPLSLRPEAC RPAAGGAVHTRGLDFACDgsgMKNLDCWVDNEEDIDVILKKSTILNLDINNDIISDISGFNS SVITYPDAQLVPGINGKAIHLVNNESSEVIVHKAMDIEYNDMFNNFTVSFWLRVPKVSASHL EQYGTNEYSIISSMKKHSLSIGSGWSVSLKGNNLIWTLKDSAGEVRQITFRDLPDKFNAYLA NKWVFITITNDRLSSANLYINGVLMGSAEITGLGAIREDNNITLKLDRCNNNNQYVSIDKFR IFCKALNPKEIEKLYTSYLSITFLRDFWGNPLRYDTEYYLIPVASSSKDVQLKNITDYMYLT NAPSYTNGKLNIYYRRLYNGLKFIIKRYTPNNEIDSFVKSGDFIKLYVSYNNNEHIVGYPKD GNAFNNLDRILRVGYNAPGIPLYKKMEAVKLRDLKTYSVQLKLYDDKNASLGLVGTHNGQIG NDPNRDILIASNWYFNHLKDKILGCDWYFVPTDEGWTND |
| 347 | LS-L121CG-K131C CD8-rTT | QIYEGKLTAEGLRFGIVASRFNHALVDRLVEGAIDAIVRHGGREEDITLVRVPGSWEIPVAA GELARKEnIsAVIAIGVLIRGATPHFDYIASEVSKGLADLSLELRKPITFGVITADTcgEQA IERAGTcHGNKGWEAALSAIEMANLFKSLRgsgKPTTTPAPRPPTPAPTIASQPLSLRPEAC RPAAGGAVHTRGLDFACDgsgMKNLDCWVDNEEDIDVILKKSTILNLDINNDIISDISGFNS SVITYPDAQLVPGINGKAIHLVNNESSEVIVHKAMDIEYNDMFNNFTVSFWLRVPKVSASHL EQYGTNEYSIISSMKKHSLSIGSGWSVSLKGNNLIWTLKDSAGEVRQITFRDLPDKFNAYLA NKWVFITITNDRLSSANLYINGVLMGSAEITGLGAIREDNNITLKLDRCNNNNQYVSIDKFR |

TABLE 1-continued

Exemplary sequences of fusion proteins containing a protein nanoparticle subunit fused to a heterologous carrier protein and optionally a heterologous T-cell helper epitope.

| SEQ ID NO | Name | Sequence |
|---|---|---|
| | | IFCKALNPKEIEKLYTSYLSITFLRDFWGNPLRYDTEYYLIPVASSSKDVQLKNITDYMYLT NAPSYTNGKLNIYYRRLYNGLKFIIKRYTPNNEIDSFVKSGDFIKLYVSYNNNEHIVGYPKD GNAFNNLDRILRVGYNAPGIPLYKKMEAVKLRDLKTYSVQLKLYDDKNASLGLVGTHNGQIG NDPNRDILIASNWYFNHLKDKILGCDWYFVPTDEGWTND |
| 348 | LS-L121GC-K131C CD8-rTT | QIYEGKLTAEGLRFGIVASRFNHALVDRLVEGAIDAIVRHGGREEDITLVRVPGSWEIPVAA GELARKEnIsAVIAIGVLIRGATPHFDYIASEVSKGLADLSLELRKPITFGVITADTgcEQA IERAGTcHGNKGWEAALSAIEMANLFKSLRgsgKPTTTPAPRPPTPAPTIASQPLSLRPEAC RPAAGGAVHTRGLDFACDgsgMKNLDCWVDNEEDIDVILKKSTILNLDINNDIISDISGFNS SVITYPDAQLVPGINGKAIHLVNNESSEVIVHKAMDIEYNDMFNNFTVSFWLRVPKVSASHL EQYGTNEYSIISSMKKHSLSIGSGWSVSLKGNNLIWTLKDSAGEVRQITFRDLPDKFNAYLA NKWVFITITNDRLSSANLYINGVLMGSAEITGLGAIREDNNITLKLDRCNNNNQYVSIDKFR IFCKALNPKEIEKLYTSYLSITFLRDFWGNPLRYDTEYYLIPVASSSKDVQLKNITDYMYLT NAPSYTNGKLNIYYRRLYNGLKFIIKRYTPNNEIDSFVKSGDFIKLYVSYNNNEHIVGYPKD GNAFNNLDRILRVGYNAPGIPLYKKMEAVKLRDLKTYSVQLKLYDDKNASLGLVGTHNGQIG NDPNRDILIASNWYFNHLKDKILGCDWYFVPTDEGWTND |
| 349 | LS K7C-R40C hinge-rTT | QIYEGcLTAEGLRFGIVASRFNHALVDRLVEGAIDAIVcHGGREEDITLVRVPGSWEIPVAA GELARKcAVIAIGVLIRGATPHFDYIASEVSKGLADLSLELRKPITFGVITADTLEQAI ERAGTKHGNKGWEAALSAIEMANLFKSLRggsgEPKSDKTHTPPPAPELLgsgEPKSDKTHT PPPAPELLgsggMKNLDCWVDNEEDIDVILKKSTILNLDINNDIISDISGFNSSVITYPDAQ LVPGINGKAIHLVNNESSEVIVHKAMDIEYNDMFNNFTVSFWLRVPKVSASHLEQYGTNEYS IISSMKKHSLSIGSGWSVSLKGNNLIWTLKDSAGEVRQITFRDLPDKFNAYLANKWVFITIT NDRLSSANLYINGVLMGSAEITGLGAIREDNNITLKLDRCNNNNQYVSIDKFRIFCKALNPK EIEKLYTSYLSITFLRDFWGNPLRYDTEYYLIPVASSSKDVQLKNITDYMYLTNAPSYTNGK LNIYYRRLYNGLKFIIKRYTPNNEIDSFVKSGDFIKLYVSYNNNEHIVGYPKDGNAFNNLDR ILRVGYNAPGIPLYKKMEAVKLRDLKTYSVQLKLYDDKNASLGLVGTHNGQIGNDPNRDILI ASNWYFNHLKDKILGCDWYFVPTDEGWTND |
| 350 | LS-L121C-K131C hinge-rTT | QIYEGKLTAEGLRFGIVASRFNHALVDRLVEGAIDAIVRHGGREEDITLVRVPGSWEIPVAA GELARKEnIsAVIAIGVLIRGATPHFDYIASEVSKGLADLSLELRKPITFGVITADTcEQAI ERAGTcHGNKGWEAALSAIEMANLFKSLRggsgEPKSDKTHTPPPAPELLgsgEPKSDKTHT PPPAPELLgsggMKNLDCWVDNEEDIDVILKKSTILNLDINNDIISDISGFNSSVITYPDAQ LVPGINGKAIHLVNNESSEVIVHKAMDIEYNDMFNNFTVSFWLRVPKVSASHLEQYGTNEYS IISSMKKHSLSIGSGWSVSLKGNNLIWTLKDSAGEVRQITFRDLPDKFNAYLANKWVFITIT NDRLSSANLYINGVLMGSAEITGLGAIREDNNITLKLDRCNNNNQYVSIDKFRIFCKALNPK EIEKLYTSYLSITFLRDFWGNPLRYDTEYYLIPVASSSKDVQLKNITDYMYLTNAPSYTNGK LNIYYRRLYNGLKFIIKRYTPNNEIDSFVKSGDFIKLYVSYNNNEHIVGYPKDGNAFNNLDR ILRVGYNAPGIPLYKKMEAVKLRDLKTYSVQLKLYDDKNASLGLVGTHNGQIGNDPNRDILI ASNWYFNHLKDKILGCDWYFVPTDEGWTND |
| 351 | LS-L121C-K131CG hinge-rTT | QIYEGKLTAEGLRFGIVASRFNHALVDRLVEGAIDAIVRHGGREEDITLVRVPGSWEIPVAA GELARKEnIsAVIAIGVLIRGATPHFDYIASEVSKGLADLSLELRKPITFGVITADTcEQAI ERAGTcgHGNKGWEAALSAIEMANLFKSLRggsgEPKSDKTHTPPPAPELLgsgEPKSDKTH TPPPAPELLgsggMKNLDCWVDNEEDIDVILKKSTILNLDINNDIISDISGFNSSVITYPDA QLVPGINGKAIHLVNNESSEVIVHKAMDIEYNDMFNNFTVSFWLRVPKVSASHLEQYGTNEY SIISSMKKHSLSIGSGWSVSLKGNNLIWTLKDSAGEVRQITFRDLPDKFNAYLANKWVFITI TNDRLSSANLYINGVLMGSAEITGLGAIREDNNITLKLDRCNNNNQYVSIDKFRIFCKALNP KEIEKLYTSYLSITFLRDFWGNPLRYDTEYYLIPVASSSKDVQLKNITDYMYLTNAPSYTNG KLNIYYRRLYNGLKFIIKRYTPNNEIDSFVKSGDFIKLYVSYNNNEHIVGYPKDGNAFNNLD RILRVGYNAPGIPLYKKMEAVKLRDLKTYSVQLKLYDDKNASLGLVGTHNGQIGNDPNRDIL IASNWYFNHLKDKILGCDWYFVPTDEGWTND |
| 352 | LS-L121C-K131GC hinge-rTT | QIYEGKLTAEGLRFGIVASRFNHALVDRLVEGAIDAIVRHGGREEDITLVRVPGSWEIPVAA GELARKEnIsAVIAIGVLIRGATPHFDYIASEVSKGLADLSLELRKPITFGVITADTcEQAI ERAGTgcHGNKGWEAALSAIEMANLFKSLRggsgEPKSDKTHTPPPAPELLgsgEPKSDKTH TPPPAPELLgsggMKNLDCWVDNEEDIDVILKKSTILNLDINNDIISDISGFNSSVITYPDA QLVPGINGKAIHLVNNESSEVIVHKAMDIEYNDMFNNFTVSFWLRVPKVSASHLEQYGTNEY SIISSMKKHSLSIGSGWSVSLKGNNLIWTLKDSAGEVRQITFRDLPDKFNAYLANKWVFITI TNDRLSSANLYINGVLMGSAEITGLGAIREDNNITLKLDRCNNNNQYVSIDKFRIFCKALNP KEIEKLYTSYLSITFLRDFWGNPLRYDTEYYLIPVASSSKDVQLKNITDYMYLTNAPSYTNG KLNIYYRRLYNGLKFIIKRYTPNNEIDSFVKSGDFIKLYVSYNNNEHIVGYPKDGNAFNNLD RILRVGYNAPGIPLYKKMEAVKLRDLKTYSVQLKLYDDKNASLGLVGTHNGQIGNDPNRDIL IASNWYFNHLKDKILGCDWYFVPTDEGWTND |
| 353 | LS-L121CG-K131C hinge-rTT | QIYEGKLTAEGLRFGIVASRFNHALVDRLVEGAIDAIVRHGGREEDITLVRVPGSWEIPVAA GELARKEnIsAVIAIGVLIRGATPHFDYIASEVSKGLADLSLELRKPITFGVITADTcgEQA IERAGTcHGNKGWEAALSAIEMANLFKSLRggsgEPKSDKTHTPPPAPELLgsgEPKSDKTH TPPPAPELLgsggMKNLDCWVDNEEDIDVILKKSTILNLDINNDIISDISGFNSSVITYPDA QLVPGINGKAIHLVNNESSEVIVHKAMDIEYNDMFNNFTVSFWLRVPKVSASHLEQYGTNEY SIISSMKKHSLSIGSGWSVSLKGNNLIWTLKDSAGEVRQITFRDLPDKFNAYLANKWVFITI TNDRLSSANLYINGVLMGSAEITGLGAIREDNNITLKLDRCNNNNQYVSIDKFRIFCKALNP KEIEKLYTSYLSITFLRDFWGNPLRYDTEYYLIPVASSSKDVQLKNITDYMYLTNAPSYTNG KLNIYYRRLYNGLKFIIKRYTPNNEIDSFVKSGDFIKLYVSYNNNEHIVGYPKDGNAFNNLD |

TABLE 1-continued

Exemplary sequences of fusion proteins containing a protein nanoparticle subunit fused to a heterologous carrier protein and optionally a heterologous T-cell helper epitope.

| SEQ ID NO | Name | Sequence |
| --- | --- | --- |
| | | RILRVGYNAPGIPLYKKMEAVKLRDLKTYSVQLKLYDDKNASLGLVGTHNGQIGNDPNRDIL IASNWYFNHLKDKILGCDWYFVPTDEGWTND |
| 354 | LS-L121GC-K131C hinge-rTT | QIYEGKLTAEGLRFGIVASRFNHALVDRLVEGAIDAIVRHGGREEDITLVRVPGSWEIPVAA GELARKEnIsAVIAIGVLIRGATPHFDYIASEVSKGLADLSLELRKPITFGVITADTgcEQA IERAGTcHGNKGWEAALSAIEMANLFKSLRggsgEPKSDKTHTPPPAPELLgsgEPKSDKTH TPPPAPELLgsggMKNLDCWVDNEEDIDVILKKSTILNLDINNDIISDISGFNSSVITYPDA QLVPGINGKAIHLVNNESSEVIVHKAMDIEYNDMFNNFTVSFWLRVPKVSASHLEQYGTNEY SIISSMKKHSLSIGSGWSVSLKGNNLIWTLKDSAGEVRQITFRDLPDKFNAYLANKWVFITI TNDRLSSANLYINGVLMGSAEITGLGAIREDNNITLKLDRCNNNNQYVSIDKFRIFCKALNP KEIEKLYTSYLSITFLRDFWGNPLRYDTEYYLIPVASSSKDVQLKNITDYMYLTNAPSYTNG KLNIYYRRLYNGLKFIIKRYTPNNEIDSFVKSGDFIKLYVSYNNNEHIVGYPKDGNAFNNLD RILRVGYNAPGIPLYKKMEAVKLRDLKTYSVQLKLYDDKNASLGLVGTHNGQIGNDPNRDIL IASNWYFNHLKDKILGCDWYFVPTDEGWTND |
| 355 | LS-15-TT | QIYEGKLTAEGLRFGIVASRFNHALVDRLVEGAIDAIVRHGGREEDITLVRVPGSWEIPVAA GELARKEoIsAVIAIGVLIRGATPHFDYIASEVSKGLADLSLELRKPITFGVITADTLEQAI EPAGTKRGNKGWEAALGAIEMANLFKSLRggggsggggsggggsMKNLDCWVDNEEDIDVIL KKSTILNLDINNDIISDISGFNSSVITYPDAQLVPGINGKAIHLVNNESSEVIVHKAMDIEY NDMFNNFTVSFWLRVPKVSASHLEQYGTNEYSIISSMKKHSLSIGSGWSVSLKGNNLIWTLK DSAGEVRQITFRDLPDKFNAYLANKWVFITITNDRLSSANLYINGVLMGSAEITGLGAIRED NNITLKLDRCNNNNQYVSIDKFRIFCKALNPKEIEKLYTSYLSITFLRDFWGNPLRYDTEYY LIPVASSSKDVQLKNITDYMYLTNAPSYTNGKLNIYYRRLYNGLKFIIKRYTPNNEIDSFVK SGDFIKLYVSYNNNEHIVGYPKDGNAFNNLDRILRVGYNAPGIPLYKKMEAVKLRDLKTYSV QLKLYDDKNASLGLVGTHNGQIGNDPNRDILIASNWYFNHLKDKILGCDWYFVPTDEGWTND |
| 356 | LS-25-TT | QIYEGKLTAEGLRFGIVASRFNHALVDRLVEGAIDAIVRHGGREEDITLVRVPGSWEIPVAA GELARKEnIsAVIAIGVLIPGATPHFDYIASEVSKGLADLSLELRKPITFGVITADTLEQAI ERAGTKHGNKGWEAALSAIEMANLFKSLPggksggnkksdgvkessesgggsggMKNLDCWV DNEEDIDVILKKSTILNLDINNDIISDISGFNSSVITYPDAQLVPGINGKAIHLVNNESSEV IVHKAMDIEYNDMFNNFTVSFWLRVPKVSASHLEQYGTNEYSIISSMKKHSLSIGSGWSVSL KGNNLIWTLKDSAGEVRQITFRDLPDKFNAYLANKWVFITITNDRLSSANLYINGVLMGSAE ITGLGAIREDNNITLKLDRCNNNNQYVSIDKFRIFCKALNPKEIEKLYTSYLSITFLRDFWG NPLRYDTEYYLIPVASSSKDVQLKNITDYMYLTNAPSYTNGKLNIYYRRLYNGLKFIIKRYT PNNEIDSFVKSGDFIKLYVSYNNNEHIVGYPKDGNAFNNLDRILRVGYNAPGIPLYKKMEAV KLRDLKTYSVQLKLYDDKNASLGLVGTHNGQIGNDPNRDILIASNWYFNHLKDKILGCDWYF VPTDEGWTND |
| 357 | LS-30-TT | QIYEGKLTAEGLRFGIVASRFNHALVDRLVEGAIDAIVRHGGREEDITLVRVPGSWEIPVAA GELARKEoIsAVIAIGVLIPGATPHFDYIASEVSKGLADLSLELRKPITFGVITADTLEQAI EPAGTKHGNKGWEAALSAIEMANLFKSLRggggsggksggnkksdgvkessesgggsggMKN LDCWVDNEEDIDVILKKSTILNLDINNDIISDISGFNSSVITYPDAQLVPGINGKAIHLVNN ESSEVIVHKAMDIEYNDMFNNFTVSFWLRVPKVSASHLEQYGTNEYSIISSMKKHSLSIGSG WSVSLKGNNLIWTLKDSAGEVRQITFRDLPDKFNAYLANKWVFITITNDRLSSANLYINGVL MGSAEITGLGAIREDNNITLKLDRCNNNNQYVSIDKFRIFCKALNPKEIEKLYTSYLSITFL RDFWGNPLRYDTEYYLIPVASSSKDVQLKNITDYMYLTNAPSYTNGKLNIYYRRLYNGLKFI IKRYTPNNEIDSFVKSGDFIKLYVSYNNNEHIVGYPKDGNAFNNLDRILRVGYNAPGIPLYK KMEAVKLRDLKTYSVQLKLYDDKNASLGLVGTHNGQIGNDPNRDILIASNWYFNHLKDKILG CDWYFVPTDEGWTND |
| 358 | LS-35-TT | QIYEGKLTAEGLRFGIVASRFNHALVDRLVEGAIDAIVRHGGREEDITLVRVPGSWEIPVAA GELARKEnIsAVIAIGVLIPGATPHFDYIASEVSKGLADLSLELRKPITFGVITADTLEQAI ERAGTKHGNKGWEAALSAIEMANLFKSLFggksggnkksdgvkessesgggsggggg gsMKNLDCWVDNEEDIDVILKKSTILNLDINNDIISDISGFNSSVITYPDAQLVPGINGEAI HLVNNESSEVIVHKAMDIEYNDMFNNFTVSPWLRVPKVSASHLEQYGTNEYSIISSMKKHSL SIGSGWSVSLKGNNLIWTLKDSAGEVRQITFRDLPDKFNAYLANKWVFITITNDRLSSANLY INGVLMGSAEITGLGAIREDNNITLKLDRCNNNNQYVSIDKFRIFCKALNPKEIEKLYTSYL SITFLRDFWGNPLRYDTEYYLIPVASSSKDVQLKNITDYMYLTNAPSYTNGKLNIYYRRLYN GLKFIIKRYTPNNEIDSFVKSGDFIKLYVSYNNNEHIVGYPKDGNAFNNLDRILRVGYNAPG IPLYKKMEAVKLRDLKTYSVQLKLYDDKNASLGLVGTHNGQIGNDPNRDILIASNWYFNHLK DKILGCDWYFVPTDEGWTND |
| 359 | LS-20-env31-TT | QIYEGKLTAEGLRFGIVASRFNHALVDRLVEGAIDAIVRHGGREEDITLVRVPGSWEIPVAA GELARKEnIsAVIAIGVLIPGATPHFDYIASEVSKGLADLSLELRKPITFGVITADTLEQAI ERAGTKHGNKGWEAALSAIEMANLFKSLRggksggnkksdgvkSLVRAENLWVTVYYGVPVW slvrgessesgMKNLDCWVDNEEDIDVILKKSTILNLDINNDIISDISGFNSSVITYPDAQL VPGINGKAIALVNNESSEVIVHKAMDIEYNDFNNFTVSPWLRVPKVSASHLEQYGTNEYSI ISSMKKHSLSIGSGWSVSLKGNNLIWTLKDSAGEVRQITFRDLPDKFNAYLANKWVFITITN DRLSSANLYINGVLMGSAEITGLGAIREDNNITLKLDRCNNNNQYVSIDKFRIFCKALNPKE IEKLYTSYLSITFLRDFWGNPLRYDTEYYLIPVASSSKDVQLKNITDYMYLTNAPSYTNGKL NIYYRRLYNGLKFIIKRYTPNNEIDSFVKSGDFIKLYVSYNNNEHIVGYPKDGNAFNNLDRI LRVGYNAPGIPLYKKMEAVKLRDLKTYSVQLKLYDDKNASLGLVGTHNGQIGNDPNRDILIA SNWYFNHLKDKILGCDWYFVPTDEGWTND |

TABLE 1-continued

Exemplary sequences of fusion proteins containing a protein nanoparticle subunit fused to a heterologous carrier protein and optionally a heterologous T-cell helper epitope.

| SEQ ID NO | Name | Sequence |
| --- | --- | --- |
| 360 | LS-20-PADRE-TT | QIYEGKLTAEGLRFGIVASRFNHALVDRLVEGAIDAIVRHGGREEDITLVRVPGSWEIPVAAGELARKEnIsAVIAIGVLIPGATPHFDYIASEVSKGLADLSLELRKPITFGVITADTLEQAIEPAGTKAGNKGWEAALSAIEMANLFKSLRggksggnkksdgvkeSLVRAKFVAAWTLKAAAGSLVRessesgMKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND |
| 361 | LS-hinge-rTT | QIYEGKLTAEGLRFGIVASRFNHALVDRLVEGAIDAIVRHGGREEDITLVRVPGSWEIPVAAGELARKEnIsAVIAIGVLIRGATPHFDYIASEVSKGLADLSLELRKPITFGVITADTLEQAIERAGTKHGNKGWEAALSAIEMANLFKSLRggEPKSCDKTSTCPPCPAPELLggKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND |
| 362 | LS-hinge2-rTT (remove the cys from hinge) | QIYEGKLTAEGLRFGIVASRFNHALVDRLVEGAIDAIVRHGGREEDITLVRVPGSWEIPVAAGELARKEnIsAVIAIGVLIRGATPHFDYIASEVSKGLADLSLELRKPITFGVITADTLEQAIERAGTKHGNKGWEAALSAIEMANLFKSLRggEPKSDETHTPPPAPELLggKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND |
| 363 | LS-hinge2.1-rTT | QIYEGKLTAEGLRFGIVASRFNHALVDRLVEGAIDAIVRHGGREEDITLVRVPGSWEIPVAAGELARKEnIsAVIAIGVLIRGATPHFDYIASEVSKGLADLSLELRKPITFGVITADTLEQAIERAGTKHGNKGWEAALSAIEMANLFKSLRggsgEPKSDKTHTPPPAPELLgsgEPKSDKTHTPPPAPELLgsggMKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND |
| 364 | LS-hinge3-rTT (mutate th cys to Thr in hinge) | QIYEGKLTAEGLRFGIVASRFNHALVDRLVEGAIDAIVRHGGREEDITLVRVPGSWEIPVAAGELARKEnIsAVIAIGVLIRGATPHFDYIASEVSKGLADLSLELRKPITFGVITADTLEQAIERAGTKHGNKGWEAALSAIEMANLFKSLRggEPKSTDKTHTSPPPSPAPELLggKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND |
| 365 | LS-ext1-rTT (extend the N terminal of rTT) | QIYEGKLTAEGLRFGIVASRFNHALVDRLVEGAIDAIVRHGGREEDITLVRVPGSWEIPVAAGELARKEnIsAVIAIGVLIRGATPHFDYIASEVSKGLADLSLELRKPITFGVITADTLEQAIERAGTKHGNKGWEAALSAIEMANLFKSLRggITELKKLESKINVFSTPIPFSYSKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND |

TABLE 1-continued

Exemplary sequences of fusion proteins containing a protein nanoparticle subunit fused to a heterologous carrier protein and optionally a heterologous T-cell helper epitope.

| SEQ ID NO | Name | Sequence |
|---|---|---|
| 366 | LS-caIgG2a-rTT | QIYEGKLTAEGLRFGIVASRFNHALVDRLVEGAIDAIVRHGGREEDITLVRVPGSWEIPVAA GELARKEnIsAVIAIGVLIRGATPHFDYIASEVSKGLADLSLELRKPITFGVITADTLEQAI ERAGTKHGNKGWEAALSAIEMANLFKSLRgsgGSEPKIPQPQPKPQPQPQPKPQPKPEPE gsgMKNLDCWVDNEEDIDVILKKSTILNLDINNDIISDISGFNSSVITYPDAQLVPGINGKA IHLVNNESSEVIVHKAMDIEYNDMFNNFTVSFWLRVPKVSASHLEQYGTNEYSIISSMKKHS LSIGSGWSVSLKGNNLIWTLKDSAGEVRQITFRDLPDKFNAYLANKWVFITITNDRLSSANL YINGVLMGSAEITGLGAIREDNNITLKLDRCNNNQYVSIDKFRIFCKALNPKEIEKLYTSY LSITFLRDFWGNPLRYDTEYYLIPVASSSKDVQLKNITDYMYLTNAPSYTNGKLNIYYRRLY NGLKFIIKRYTPNNEIDSFVKSGDFIKLYVSYNNNEHIVGYPKDGNAFNNLDRILRVGYNAP GIPLYKKMEAVKLRDLKTYSVQLKLYDDKNASLGLVGTHNGQIGNDPNRDILIASNWYFNHL KDKILGCDWYFVPTDEGWTND |
| 367 | LS-CD8-rTT | QIYEGKLTAEGLRFGIVASRFNHALVDRLVEGAIDAIVRHGGREEDITLVRVPGSWEIPVAA GELARKEnIsAVIAIGVLIRGATPHFDYIASEVSKGLADLSLELRKPITFGVITADTLEQAI ERAGTKHGNKGWEAALSAIEMANLFKSLRgsgKPTTTPAPRPPTPAPTIASQPLSLRPEAtR PAAGGAVHTRGgsgMKNLDCWVDNEEDIDVILKKSTILNLDINNDIISDISGFNSSVITYPD AQLVPGINGKAIHLVNNESSEVIVHKAMDIEYNDMFNNFTVSFWLRVPKVSASHLEQYGTNE YSIISSMKKHSLSIGSGWSVSLKGNNLIWTLKDSAGEVRQITFRDLPDKFNAYLANKWVFIT ITNDRLSSANLYINGVLMGSAEITGLGAIREDNNITLKLDRCNNNNQYVSIDKFRIFCKALN PKEIEKLYTSYLSITFLRDFWGNPLRYDTEYYLIPVASSSKDVQLKNITDYMYLTNAPSYTN GKLNIYYRRLYNGLKFIIKRYTPNNEIDSFVKSGDFIKLYVSYNNNEHIVGYPKDGNAFNNL DRILRVGYNAPGIPLYKKMEAVKLRDLKTYSVQLKLYDDKNASLGLVGTHNGQIGNDPNRDI LIASNWYFNHLKDKILGCDWYFVPTDEGWTND |
| 368 | LS-CD8v2-rTT | QIYEGKLTAEGLRFGIVASRFNHALVDRLVEGAIDAIVRHGGREEDITLVRVPGSWEIPVAA GELARKEnIsAVIAIGVLIRGATPHFDYIASEVSKGLADLSLELRKPITFGVITADTLEQAI ERAGTKHGNKGWEAALSAIEMANLFKSLRgsgKPTTTPAPRPPTPAPTIASQPLSLRPEACR PAAGGAVHTRGLDFACDgsgMKNLDCWVDNEEDIDVILKKSTILNLDINNDIISDISGFNSS VITYPDAQLVPGINGKAIHLVNNESSEVIVHKAMDIEYNDMFNNFTVSFWLRVPKVSASHLE QYGTNEYSIISSMKKHSLSIGSGWSVSLKGNNLIWTLKDSAGEVRQITFRDLPDKFNAYLAN KWVFITITNDRLSSANLYINGVLMGSAEITGLGAIREDNNITLKLDRCNNNQYVSIDKFRI FCKALNPKEIEKLYTSYLSITFLRDFWGNPLRYDTEYYLIPVASSSKDVQLKNITDYMYLTN APSYTNGKLNIYYRRLYNGLKFIIKRYTPNNEIDSFVKSGDFIKLYVSYNNNEHIVGYPKDG NAFNNLDRILRVGYNAPGIPLYKKMEAVKLRDLKTYSVQLKLYDDKNASLGLVGTHNGQIGN DPNRDILIASNWYFNHLKDKILGCDWYFVPTDEGWTND |
| | Ferritin | |
| 109 | rTT-ferr 1 | NLDCWVDNEEDIDVILKKSTILNLDINNDIISDISGFNSAVITYPDAQLVPGINGKAIHLVN NEASEVIVHKAMDIEYNDMFNQFTVSFWLRVPKVSASHLEQYGTNEYSIISSMKKHSLSIGS GWSVSLKGNNLIWTLKDSAGEVRQITFRDLPDKFNAYLANKWVFITITNDRLSSANLYINGV LMGSAEITGLGAIREDNQITLKLDRCNNNQYVSIDKFRIFCKALNPKEIEKLYTSYLSITF LRDFWGNPLRYDTEYYLIPVASSSKDVQLKQITDYMYLTNAPSYTNGKLNIYYRRLYNGLKF IIKRYTPNNEIDSFVKSGDFIKLYVSYNNNEHIVGYPKDGNAFNNLDRILRVGYNAPGIPLY KKMEAVKLRDLKTYSVQLKLYDDKNASLGLVGTHNGQIGNDPNRDILIASNWYFNHLKDKIL GCDWYFVPTDEGWTNDggsgggsggASISEKMVEALNRQINAEIYSAYLYLSMASYFDSIGL KGFSNWMRVQWQEELMHAMKMFDFVSRRGGRVKLYAVEEPPSEWDSPLAAFEHVYEHEVNVV KRIHELVEMAMQEKDFATYNFLQWYVAEQVEEEASALDIVEKLRLIGEDKRALLFLDKELSL RQFTPPAEEEK |
| 110 | rTT-ferr 2 | NLDCWVDNEEDIDVILKKSTILNLDINNDIISDISGFNSAVITYPDAQLVPGINGKAIHLVN NEASEVIVHKAMDIEYNDMFNQFTVSFWLRVPKVSASHLEQYGTNEYSIISSMKKHSLSIGS GWSVSLKGNNLIWTLKDSAGEVRQITFRDLPDKFNAYLANKWVFITITNDRLSSANLYINGV LMGSAEITGLGAIREDNQITLKLDRCNNNQYVSIDKFRIFCKALNPKEIEKLYTSYLSITF LRDFWGNPLRYDTEYYLIPVASSSKDVQLKQITDYMYLTNAPSYTNGKLNIYYRRLYNGLKF IIKRYTPNNEIDSFVKSGDFIKLYVSYNNNEHIVGYPKDGNAFNNLDRILRVGYNAPGIPLY KKMEAVKLRDLKTYSVQLKLYDDKNASLGLVGTHNGQIGNDPNRDILIASNWYFNHLKDKIL GCDWYFVPTDEGWTNDggsgggsgggsggsgASISEKMVEALNRQINAEIYSAYLYLSMASY FDSIGLKGFSNWMRVQWQEELMHAMKMFDFVSRRGGRVKLYAVEEPPSEWDSPLAAFEHVYE HEVNVVKRIHELVEMAMQEKDFATYNFLQWYVAEQVEEEASALDIVEKLRLIGEDKRALLFL DKELSLRQFTPPAEEEK |
| 111 | rTT-ferr 3 | NLDCWVDNEEDIDVILKKSTILNLDINNDIISDISGFNSAVITYPDAQLVPGINGKAIHLVN NEASEVIVHKAMDIEYNDMFNQFTVSFWLRVPKVSASHLEQYGTNEYSIISSMKKHSLSIGS GWSVSLKGNNLIWTLKDSAGEVRQITFRDLPDKFNAYLANKWVFITITNDRLSSANLYINGV LMGSAEITGLGAIREDNQITLKLDRCNNNQYVSIDKFRIFCKALNPKEIEKLYTSYLSITF LRDFWGNPLRYDTEYYLIPVASSSKDVQLKQITDYMYLTNAPSYTNGKLNIYYRRLYNGLKF IIKRYTPNNEIDSFVKSGDFIKLYVSYNNNEHIVGYPKDGNAFNNLDRILRVGYNAPGIPLY KKMEAVKLRDLKTYSVQLKLYDDKNASLGLVGTHNGQIGNDPNRDILIASNWYFNHLKDKIL GCDWYFVPTDEGWTNDggdgggdgggdggdgASISEKMVEALNRQINAEIYSAYLYLSMASY FDSIGLKGFSNWMRVQWQEELMHAMKMFDFVSRRGGRVKLYAVEEPPSEWDSPLAAFEHVYE HEVNVVKRIHELVEMAMQEKDFATYNFLQWYVAEQVEEEASALDIVEKLRLIGEDKRALLFL DKELSLRQFTPPAEEEK |

TABLE 1-continued

Exemplary sequences of fusion proteins containing a protein nanoparticle subunit fused to a heterologous carrier protein and optionally a heterologous T-cell helper epitope.

| SEQ ID NO | Name | Sequence |
|---|---|---|
| 112 | rTT-ferr 4 | NLDCWVDNEEDIDVILKKSTILNLDINNDIISDISGFNSAVITYPDAQLVPGINGKAIHLVN NEASEVIVHKAMDIEYNDMFNQFTVSFWLRVPKVSASHLEQYGTNEYSIISSMKKHSLSIGS GWSVSLKGNNLIWTLKDSAGEVRQITFRDLPDKFNAYLANKWVFITITNDRLSSANLYINGV LMGSAEITGLGAIREDNQITLKLDRCNNNNQYVSIDKFRIFCKALNPKEIEKLYTSYLSITF LRDFWGNPLRYDTEYYLIPVASSSKDVQLKQITDYMYLTNAPSYTNGKLNIYYRRLYNGLKF IIKRYTPNNEIDSFVKSGDFIKLYVSYNNNEHIVGYPKDGNAFNNLDRILRVGYNAPGIPLY KKMEAVKLRDLKTYSVQLKLYDDKNASLGLVGTHNGQIGNDPNRDILIASNWYFNHLKDKIL GCDWYFVPTDEGWTNDggsgggsggMLSKDIIKLLNEQVNKEMDSSNLYMSMSSWCYTHSLD GAGLFLFDHAAEEYEHAKKLIIFLNENNVPVQLTSISAPEHKFEGLTQIFQKAYEHEQHISE SINNIVDHAIKSKDHATFNFLQWYVAEQHEEEVLFKDILDKIELIGNENHGLYLADQYVKGI AKSRKS |
| 113 | rTT-ferr 5 | NLDCWVDNEEDIDVILKKSTILNLDINNDIISDISGFNSAVITYPDAQLVPGINGKAIHLVN NEASEVIVHKAMDIEYNDMFNQFTVSFWLRVPKVSASHLEQYGTNEYSIISSMKKHSLSIGS GWSVSLKGNNLIWTLKDSAGEVRQITFRDLPDKFNAYLANKWVFITITNDRLSSANLYINGV LMGSAEITGLGAIREDNQITLKLDRCNNNNQYVSIDKFRIFCKALNPKEIEKLYTSYLSITF LRDFWGNPLRYDTEYYLIPVASSSKDVQLKQITDYMYLTNAPSYTNGKLNIYYRRLYNGLKF IIKRYTPNNEIDSFVKSGDFIKLYVSYNNNEHIVGYPKDGNAFNNLDRILRVGYNAPGIPLY KKMEAVKLRDLKTYSVQLKLYDDKNASLGLVGTHNGQIGNDPNRDILIASNWYFNHLKDKIL GCDWYFVPTDEGWTNDggsgggsgggsggsgMLSKDIIKLLNEQVNKEMDSSNLYMSMSSWC YTHSLDGAGLFLFDHAAEEYEHAKKLIIFLNENNVPVQLTSISAPEHKFEGLTQIFQKAYEH EQHISESINNIVDHAIKSKDHATFNFLQWYVAEQHEEEVLFKDILDKIELIGNENHGLYLAD QYVKGIAKSRKS |
| 114 | rTT-ferr 6 | NLDCWVDNEEDIDVILKKSTILNLDINNDIISDISGFNSAVITYPDAQLVPGINGKAIHLVN NEASEVIVHKAMDIEYNDMFNQFTVSFWLRVPKVSASHLEQYGTNEYSIISSMKKHSLSIGS GWSVSLKGNNLIWTLKDSAGEVRQITFRDLPDKFNAYLANKWVFITITNDRLSSANLYINGV LMGSAEITGLGAIREDNQITLKLDRCNNNNQYVSIDKFRIFCKALNPKEIEKLYTSYLSITF LRDFWGNPLRYDTEYYLIPVASSSKDVQLKQITDYMYLTNAPSYTNGKLNIYYRRLYNGLKF IIKRYTPNNEIDSFVKSGDFIKLYVSYNNNEHIVGYPKDGNAFNNLDRILRVGYNAPGIPLY KKMEAVKLRDLKTYSVQLKLYDDKNASLGLVGTHNGQIGNDPNRDILIASNWYFNHLKDKIL GCDWYFVPTDEGWTNDggdgggdgggdggdgMLSKDIIKLLNEQVNKEMDSSNLYMSMSSWC YTHSLDGAGLFLFDHAAEEYEHAKKLIIFLNENNVPVQLTSISAPEHKFEGLTQIFQKAYEH EQHISESINNIVDHAIKSKDHATFNFLQWYVAEQHEEEVLFKDILDKIELIGNENHGLYLAD QYVKGIAKSRKS |
| 115 | rTT_degly-Fer | MKNLDCWVDNEEDIDVILKKSTILNLDINNDIISDISGFNSAVITYPDAQLVPGINGKAIHL VNNEASEVIVHKAMDIEYNDMFNNFTVSFWLRVPKVSASHLEQYGTNEYSIISSMKKHSLSI GSGWSVSLKGNNLIWTLKDSAGEVRQITFRDLPDKFNAYLANKWVFITITNDRLSSANLYIN GVLMGSAEITGLGAIREDNQITLKLDRCNNNNQYVSIDKFRIFCKALNPKEIEKLYTSYLSI TFLRDFWGNPLRYDTEYYLIPVASSSKDVQLKQITDYMYLTNAPSYTNGKLNIYYRRLYNGL KFIIKRYTPNNEIDSFVKSGDFIKLYVSYNNNEHIVGYPKDGNAFNNLDRILRVGYNAPGIP LYKKMEAVKLRDLKTYSVQLKLYDDKQASLGLVGTHNGQIGNDPNRDILIASNWYFNHLKDK ILGCDWYFVPTDEGWTNDgggSGGDIIKLLNEQVNKEMQSSNLYMSMSSWCYTHSLDGAGLF LFDHAAEEYEHAKKLIIFLNENNVPVQLTSISAPEHKFEGLTQIFQKAYEHEQHISESINNI VDHAIKSKDHATFNFLQWYVAEQHEEEVLFKDILDKIELIGNENHGLYLADQYVKGIAKSRK S |
| 116 | rTT_degly-ln15-Fer | MKNLDCWVDNEEDIDVILKKSTILNLDINNDIISDISGFNSAVITYPDAQLVPGINGKAIHL VNNEASEVIVHKAMDIEYNDMFNNFTVSFWLRVPKVSASHLEQYGTNEYSIISSMKKHSLSI GSGWSVSLKGNNLIWTLKDSAGEVRQITFRDLPDKFNAYLANKWVFITITNDRLSSANLYIN GVLMGSAEITGLGAIREDNQITLKLDRCNNNNQYVSIDKFRIFCKALNPKEIEKLYTSYLSI TFLRDFWGNPLRYDTEYYLIPVASSSKDVQLKQITDYMYLTNAPSYTNGKLNIYYRRLYNGL KFIIKRYTPNNEIDSFVKSGDFIKLYVSYNNNEHIVGYPKDGNAFNNLDRILRVGYNAPGIP LYKKMEAVKLRDLKTYSVQLKLYDDKQASLGLVGTHNGQIGNDPNRDILIASNWYFNHLKDK ILGCDWYFVPTDEGWTNDgggsSGGgggsgggSGGgDIIKLLNEQVNKEMQSSNLYMSMSSWCYT HSLDGAGLFLFDHAAEEYEHAKKLIIFLNENNVPVQLTSISAPEHKFEGLTQIFQKAYEHEQ HISESINNIVDHAIKSKDHATFNFLQWYVAEQHEEEVLFKDILDKIELIGNENHGLYLADQY VKGIAKSRKS |
| 117 | rTT_degly-ln25-Fer | MKNLDCWVDNEEDIDVILKKSTILNLDINNDIISDISGFNSAVITYPDAQLVPGINGKAIHL VNNEASEVIVHKAMDIEYNDMFNNFTVSFWLRVPKVSASHLEQYGTNEYSIISSMKKHSLSI GSGWSVSLKGNNLIWTLKDSAGEVRQITFRDLPDKFNAYLANKWVFITITNDRLSSANLYIN GVLMGSAEITGLGAIREDNQITLKLDRCNNNNQYVSIDKFRIFCKALNPKEIEKLYTSYLSI TFLRDFWGNPLRYDTEYYLIPVASSSKDVQLKQITDYMYLTNAPSYTNGKLNIYYRRLYNGL KFIIKRYTPNNEIDSFVKSGDFIKLYVSYNNNEHIVGYPKDGNAFNNLDRILRVGYNAPGIP LYKKMEAVKLRDLKTYSVQLKLYDDKQASLGLVGTHNGQIGNDPNRDILIASNWYFNHLKDK ILGCDWYFVPTDEGWTNDgggSGGggsgggSGGggSGGggDIIKLLNEQVNKEMQSSNL YMSMSSWCYTHSLDGAGLFLFDHAAEEYEHAKKLIIFLNENNVPVQLTSISAPEHKFEGLTQ IFQKAYEHEQHISESINNIVDHAIKSKDHATFNFLQWYVAEQHEEEVLFKDILDKIELIGNE NHGLYLADQYVKGIAKSRKS |

TABLE 1-continued

Exemplary sequences of fusion proteins containing a protein nanoparticle subunit fused to a heterologous carrier protein and optionally a heterologous T-cell helper epitope.

| SEQ ID NO | Name | Sequence |
|---|---|---|
| 118 | rTT_degly-ln35-Fer | MKNLDCWVDNEEDIDVILKKSTILNLDINNDIISDISGFNSAVITYPDAQLVPGINGKAIHL VNNEASEVIVHKAMDIEYNDMFNNFTVSFWLRVPKVSASHLEQYGTNEYSIISSMKKHSLSI GSGWSVSLKGNNLIWTLKDSAGEVRQITFRDLPDKFNAYLANKWVFITITNDRLSSANLYIN GVLMGSAEITGLGAIREDNQITLKLDRCNNNQYVSIDKFRIFCKALNPKEIEKLYTSYLSI TFLRDFWGNPLRYDTEYYLIPVASSSKDVQLKQITDYMLTNAPSYTNGKLNIYYRRLYNGL KFIIKRYTPNNEIDSFVKSGDFIKLYVSYNNNEHIVGYPKDGNAFNNLDRILRVGYNAPGIP LYKKMEAVKLRDLKTYSVQLKLYDDKQASLGLVGTHNGQIGNDPNRDILIASNWYFNHLKDK ILGCDWYFVPTDEGWTNDgggSGGggsggSGGggSGGggSGGggSGGggSGGg*DIIKLLNEQ VNKEMQSSNLYMSMSSWCYTHSLDGAGLFLFDHAAEEYEHAKKLIIFLNENNVPVQLTSISA PEHKFEGLTQIFQKAYEHEQHISESINNIVDHAIKSKDHATFNFLQWYVAEQHEEEVLFKDI LDKIELIGNENHGLYLADQYVKGIAKSRKS* |
| 119 | rTT_degly-K5A-Fer | MKNLDCWVDkEEDIDVILKKSTILNLDINkDIISDISkFNSAVITYPDAQLVPGINGKAIHL VNNEkSEVIVHKAMkIEYNDMFNNFTVSFWLRVPKVSASHLEQYGTNEYSIISSMKKHSLSI GSGWSVSLKGNNLIWTLKDSAGEVRQITFRDLPDKFNAYLANKWVFITITNDRLSSANLYIN GVLMGSAEITGLGAIREDNQITLKLDRCNNNQYVSIDKFRIFCKALNPKEIEKLYTSYLSI TFLRDFWGNPLRYDTEYYLIPVASSSKDVQLKQITDYMLTNAPSYTNGKLNIYYRRLYNGL KFIIKRYTPNNEIDSFVKSGDFIKLYVSYNNNEHIVGYPKDGNAFNNLDRILRVGYNAPGIP LYKKMEAVKLRDLKTYSVQLKLYDDKQASLGLVGTHNGQIGNDPNRDILIASNWYFNHLKDK ILGCDWYFVPTDEGWTNDgggSGGD*IIKLLNEQVNKEMQSSNLYMSMSSWCYTHSLDGAGLF LFDHAAEEYEHAKKLIIFLNENNVPVQLTSISAPEHKFEGLTQIFQKAYEHEQHISESINNI VDHAIKSKDHATFNFLQWYVAEQHEEEVLFKDILDKIELIGNENHGLYLADQYVKGIAKSRK S* |
| 120 | rTT_degly-K5B-Fer | MKNLDCWVDNEEDIDVILKKSTILNLDINNDIISDISGFNSAVITYPDAQLVPGINGKAIHL VNNEASEVIVHKAMDIEYNDMFNNFTVSFWLRVPKVSASHLEQYGTNEYSIISSMKKHkkSI GSGWSVSLKGNNLIWTLKDSkGEVRQITFRDLPkKFNAYLANKWVFITITNDRkSSANLYIN GVLMGSAEITGLGAIREDNQITLKLDRCNNNQYVSIDKFRIFCKALNPKEIEKLYTSYLSI TFLRDFWGNPLRYDTEYYLIPVASSSKDVQLKQITDYMLTNAPSYTNGKLNIYYRRLYNGL KFIIKRYTPNNEIDSFVKSGDFIKLYVSYNNNEHIVGYPKDGNAFNNLDRILRVGYNAPGIP LYKKMEAVKLRDLKTYSVQLKLYDDKQASLGLVGTHNGQIGNDPNRDILIASNWYFNHLKDK ILGCDWYFVPTDEGWTNDgggSGGD*IIKLLNEQVNKEMQSSNLYMSMSSWCYTHSLDGAGLF LFDHAAEEYEHAKKLIIFLNENNVPVQLTSISAPEHKFEGLTQIFQKAYEHEQHISESINNI VDHAIKSKDHATFNFLQWYVAEQHEEEVLFKDILDKIELIGNENHGLYLADQYVKGIAKSRK S* |
| 121 | rTT_degly-K5C-Fer | MKNLDCWVDNEEDIDVILKKSTILNLDINNDIISDISGFNSAVITYPDAQLVPGINGKAIHL VNNEASEVIVHKAMDIEYNDMFNNFTVSFWLRVPKVSASHLEQYGTNEYSIISSMKKHSLSI GSGWSVSLKGNNLIWTLKDSAGEVRQITFRDLPDKFNAYLANKWVFITITNDRLSSANLYIN GVLMGSAEITkLGAIREDNQITLKLDRCkNNNQYVSIDKFRIFCKALNPKEIEKLYTSYLSI TFLRDFWGNPLRYDTEYYLIPVASSSKDVQLKQITDYMLTkAPSYTNGKLNIYYRRLYNGL KFIIKRYkPNNkIDSFVKSGDFIKLYVSYNNNEHIVGYPKDGNAFNNLDRILRVGYNAPGIP LYKKMEAVKLRDLKTYSVQLKLYDDKQASLGLVGTHNGQIGNDPNRDILIASNWYFNHLKDK ILGCDWYFVPTDEGWTNDggg*SGGDIIKLLNEQVNKEMQSSNLYMSMSSWCYTHSLDGAGLF LFDHAAEEYEHAKKLIIFLNENNVPVQLTSISAPEHKFEGLTQIFQKAYEHEQHISESINNI VDHAIKSKDHATFNFLQWYVAEQHEEEVLFKDILDKIELIGNENHGLYLADQYVKGIAKSRK S* |
| 122 | rTT_degly-K5D-Fer | MKNLDCWVDNEEDIDVILKKSTILNLDINNDIISDISGFNSAVITYPDAQLVPGINGKAIHL VNNEASEVIVHKAMDIEYNDMFNNFTVSFWLRVPKVSASHLEQYGTNEYSIISSMKKHSLSI GSGWSVSLKGNNLIWTLKDSAGEVRQITFRDLPDKFNAYLANKWVFITITNDRLSSANLYIN GVLMGSAEITGLGAIREDNQITLKLDRCNNNQYVSIDKFRIFCKALNPKEIEKLYTSYLSI TFLRDFWGNPLRYDTEYYLIPVASSSKDVQLKQITDYMLTNAPSYTNGKLNIYYRRLYNGL KFIIKRYTPNNEIDSFVKSGDFIKLYVSYkNNEHIVGYPKDGNAFNkLDRILRVGYkAPkIP LYKKMEAVKLRDLKTYSVQLKLYDDKQASLGLVGTHNGQIGkDPNRDILIASNWYFNHLKDK ILGCDWYFVPTDEGWTNDggg*SGGDIIKLLNEQVNKEMQSSNLYMSMSSWCYTHSLDGAGLF LFDHAAEEYEHAKKLIIFLNENNVPVQLTSISAPEHKFEGLTQIFQKAYEHEQHISESINNI VDHAIKSKDHATFNFLQWYVAEQHEEEVLFKDILDKIELIGNENHGLYLADQYVKGIAKSRK S* |
| 123 | rTT_degly-K10A-Fer | MKNLDCWVDkEEDIDVILKKSTILNLDINkDIISDISkFNSAVITYPDAQLVPGINGKAIHL VNNEkSEVIVHKAMkIEYNDMFNNFTVSFWLRVPKVSASHLEQYGTNEYSIISSMKKHkkSI GSGWSVSLKGNNLIWTLKDSkGEVRQITFRDLPkKFNAYLANKWVFITITNDRkSSANLYIN GVLMGSAEITGLGAIREDNQITLKLDRCNNNQYVSIDKFRIFCKALNPKEIEKLYTSYLSI TFLRDFWGNPLRYDTEYYLIPVASSSKDVQLKQITDYMLTNAPSYTNGKLNIYYRRLYNGL KFIIKRYTPNNEIDSFVKSGDFIKLYVSYNNNEHIVGYPKDGNAFNNLDRILRVGYNAPGIP LYKKMEAVKLRDLKTYSVQLKLYDDKQASLGLVGTHNGQIGNDPNRDILIASNWYFNHLKDK ILGCDWYFVPTDEGWTNDggg*SGGDIIKLLNEQVNKEMQSSNLYMSMSSWCYTHSLDGAGLF LFDHAAEEYEHAKKLIIFLNENNVPVQLTSISAPEHKFEGLTQIFQKAYEHEQHISESINNI VDHAIKSKDHATFNFLQWYVAEQHEEEVLFKDILDKIELIGNENHGLYLADQYVKGIAKSRK S* |

TABLE 1-continued

Exemplary sequences of fusion proteins containing a protein nanoparticle subunit fused to a heterologous carrier protein and optionally a heterologous T-cell helper epitope.

| SEQ ID NO | Name | Sequence |
|---|---|---|
| 124 | rTT_degly-K10B-Fer | MKNLDCWVDNEEDIDVILKKSTILNLDINNDIISDISGFNSAVITYPDAQLVPGINGKAIHL<br>VNNEASEVIVHKAMDIEYNDMFNNFTVSFWLRVPKVSASHLEQYGTNEYSIISSMKKHSLSI<br>GSGWSVSLKGNNLIWTLKDSAGEVRQITFRDLPDKFNAYLANKWVFITITNDRLSSANLYIN<br>GVLMGSAEITkLGAIREDNQITLKLDRCkNNNQYVSIDKFRIFCKALNPKEIEKLYTSYLSI<br>TFLRDFWGNPLRYDTEYYLIPVASSSKDVQLKQITDYMYLTkAPSYTNGKLNIYYRRLYNGL<br>KFIIKRYkPNNkIDSFVKSGDFIKLYVSYkNNEHIVGYPKDGNAFNkLDRILRVGYkAPkIP<br>LYKKMEAVKLRDLKTYSVQLKLYDDKQASLGLVGTHNGQIGkDPNRDILIASNWYFNHLKDK<br>ILGCDWYFVPTDEGWTNDgggSGG*DIIKLLNEQVNKEMQSSNLYMSMSSWCYTHSLDGAGLF*<br>*LFDHAAEEYEHAKKLIIFLNENNVPVQLTSISAPEHKFEGLTQIFQKAYEHEQHISESINNI*<br>*VDHAIKSKDHATFNFLQWYVAEQHEEEVLFKDILDKIELIGNENHGLYLADQYVKGIAKSRK*<br>*S* |
| 125 | rTT_degly-K10C-Fer | MKNLDCWVDkEEDIDVILKKSTILNLDINkDIISDISkFNSAVITYPDAQLVPGINGKAIHL<br>VNNEkSEVIVHKAMkIEYNDMFNNFTVSFWLRVPKVSASHLEQYGTNEYSIISSMKKHSLSI<br>GSGWSVSLKGNNLIWTLKDSAGEVRQITFRDLPDKFNAYLANKWVFITITNDRLSSANLYIN<br>GVLMGSAEITkLGAIREDNQITLKLDRCkNNNQYVSIDKFRIFCKALNPKEIEKLYTSYLSI<br>TFLRDFWGNPLRYDTEYYLIPVASSSKDVQLKQITDYMYLTkAPSYTNGKLNIYYRRLYNGL<br>KFIIKRYkPNNkIDSFVKSGDFIKLYVSYNNNEHIVGYPKDGNAFNNLDRILRVGYNAPGIP<br>LYKKMEAVKLRDLKTYSVQLKLYDDKQASLGLVGTHNGQIGNDPNRDILIASNWYFNHLKDK<br>ILGCDWYFVPTDEGWTNDgggSGG*DIIKLLNEQVNKEMQSSNLYMSMSSWCYTHSLDGAGLF*<br>*LFDHAAEEYEHAKKLIIFLNENNVPVQLTSISAPEHKFEGLTQIFQKAYEHEQHISESINNI*<br>*VDHAIKSKDHATFNFLQWYVAEQHEEEVLFKDILDKIELIGNENHGLYLADQYVKGIAKSRK*<br>*S* |
| 126 | rTT_degly-K10D-Fer | MKNLDCWVDNEEDIDVILKKSTILNLDINNDIISDISGFNSAVITYPDAQLVPGINGKAIHL<br>VNNEASEVIVHKAMDIEYNDMFNNFTVSFWLRVPKVSASHLEQYGTNEYSIISSMKKHkkSI<br>GSGWSVSLKGNNLIWTLKDSkGEVRQITFRDLPkKFNAYLANKWVFITITNDRkSSANLYIN<br>GVLMGSAEITGLGAIREDNQITLKLDRCNNNNQYVSIDKFRIFCKALNPKEIEKLYTSYLSI<br>TFLRDFWGNPLRYDTEYYLIPVASSSKDVQLKQITDYMYLTNAPSYTNGKLNIYYRRLYNGL<br>KFIIKRYTPNNEIDSFVKSGDFIKLYVSYkNNEHIVGYPKDGNAFNkLDRILRVGYkAPkIP<br>LYKKMEAVKLRDLKTYSVQLKLYDDKQASLGLVGTHNGQIGkDPNRDILIASNWYFNHLKDK<br>ILGCDWYFVPTDEGWTNDgggSGG*DIIKLLNEQVNKEMQSSNLYMSMSSWCYTHSLDGAGLF*<br>*LFDHAAEEYEHAKKLIIFLNENNVPVQLTSISAPEHKFEGLTQIFQKAYEHEQHISESINNI*<br>*VDHAIKSKDHATFNFLQWYVAEQHEEEVLFKDILDKIELIGNENHGLYLADQYVKGIAKSRK*<br>*S* |
| 127 | rTT_degly-K15A-Fer | MKNLDCWVDkEEDIDVILKKSTILNLDINkDIISDISkFNSAVITYPDAQLVPGINGKAIHL<br>VNNEkSEVIVHKAMkIEYNDMFNNFTVSFWLRVPKVSASHLEQYGTNEYSIISSMKKHkkSI<br>GSGWSVSLKGNNLIWTLKDSkGEVRQITFRDLPkKFNAYLANKWVFITITNDRkSSANLYIN<br>GVLMGSAEITkLGAIREDNQITLKLDRCkNNNQYVSIDKFRIFCKALNPKEIEKLYTSYLSI<br>TFLRDFWGNPLRYDTEYYLIPVASSSKDVQLKQITDYMYLTkAPSYTNGKLNIYYRRLYNGL<br>KFIIKRYkPNNkIDSFVKSGDFIKLYVSYNNNEHIVGYPKDGNAFNNLDRILRVGYNAPGIP<br>LYKKMEAVKLRDLKTYSVQLKLYDDKQASLGLVGTHNGQIGNDPNRDILIASNWYFNHLKDK<br>ILGCDWYFVPTDEGWTNDgggSGG*DIIKLLNEQVNKEMQSSNLYMSMSSWCYTHSLDGAGLF*<br>*LFDHAAEEYEHAKKLIIFLNENNVPVQLTSISAPEHKFEGLTQIFQKAYEHEQHISESINNI*<br>*VDHAIKSKDHATFNFLQWYVAEQHEEEVLFKDILDKIELIGNENHGLYLADQYVKGIAKSRK*<br>*S* |
| 128 | rTT_degly-K15B-Fer | MKNLDCWVDNEEDIDVILKKSTILNLDINNDIISDISGFNSAVITYPDAQLVPGINGKAIHL<br>VNNEASEVIVHKAMDIEYNDMFNNFTVSFWLRVPKVSASHLEQYGTNEYSIISSMKKHkkSI<br>GSGWSVSLKGNNLIWTLKDSkGEVRQITFRDLPkKFNAYLANKWVFITITNDRKSSANLYIN<br>GVLMGSAEITkLGAIREDNQITLKLDRCkNNNQYVSIDKFRIFCKALNPKEIEKLYTSYLSI<br>TFLRDFWGNPLRYDTEYYLIPVASSSKDVQLKQITDYMYLTkAPSYTNGKLNIYYRRLYNGL<br>KFIIKRYkPNNkIDSFVKSGDFIKLYVSYkNNEHIVGYPKDGNAFNkLDRILRVGYkAPkIP<br>LYKKMEAVKLRDLKTYSVQLKLYDDKQASLGLVGTHNGQIGkDPNRDILIASNWYFNHLKDK<br>ILGCDWYFVPTDEGWTNDgggSGG*DIIKLLNEQVNKEMQSSNLYMSMSSWCYTHSLDGAGLF*<br>*LFDHAAEEYEHAKKLIIFLNENNVPVQLTSISAPEHKFEGLTQIFQKAYEHEQHISESINNI*<br>*VDHAIKSKDHATFNFLQWYVAEQHEEEVLFKDILDKIELIGNENHGLYLADQYVKGIAKSRK*<br>*S* |
| 129 | rTT_degly-K15C-Fer | MKNLDCWVDkEEDIDVILKKSTILNLDINkDIISDISkFNSAVITYPDAQLVPGINGKAIHL<br>VNNEkSEVIVHKAMkIEYNDMFNNFTVSFWLRVPKVSASHLEQYGTNEYSIISSMKKHSLSI<br>GSGWSVSLKGNNLIWTLKDSAGEVRQITFRDLPDKFNAYLANKWVFITITNDRLSSANLYIN<br>GVLMGSAEITkLGAIREDNQITLKLDRCkNNNQYVSIDKFRIFCKALNPKEIEKLYTSYLSI<br>TFLRDFWGNPLRYDTEYYLIPVASSSKDVQLKQITDYMYLTkAPSYTNGKLNIYYRRLYNGL<br>KFIIKRYkPNNkIDSFVKSGDFIKLYVSYkNNEHIVGYPKDGNAFNkLDRILRVGYkAPkIP<br>LYKKMEAVKLRDLKTYSVQLKLYDDKQASLGLVGTHNGQIGkDPNRDILIASNWYFNHLKDK<br>ILGCDWYFVPTDEGWTNDgggSGG*DIIKLLNEQVNKEMQSSNLYMSMSSWCYTHSLDGAGLF*<br>*LFDHAAEEYEHAKKLIIFLNENNVPVQLTSISAPEHKFEGLTQIFQKAYEHEQHISESINNI*<br>*VDHAIKSKDHATFNFLQWYVAEQHEEEVLFKDILDKIELIGNENHGLYLADQYVKGIAKSRK*<br>*S* |

TABLE 1-continued

Exemplary sequences of fusion proteins containing a protein nanoparticle subunit fused to a heterologous carrier protein and optionally a heterologous T-cell helper epitope.

| SEQ ID NO | Name | Sequence |
|---|---|---|
| 130 | rTT_degly-K15D-Fer | MKNLDCWVDkEEDIDVILKKSTILNLDINkDIISDISkFNSAVITYPDAQLVPGINGKAIHLVNNEkSEVIVHKAMkIEYNDMFNNFTVSFWLRVPKVSASHLEQYGTNEYSIISSMKKHkkSIGSGWSVSLKGNNLIWTLKDSkGEVRQITFRDLPkKFNAYLANKWVFITITNDRKSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYkNNEHIVGYPKDGNAFNkLDRILRVGYkAPkIPLYKKMEAVKLRDLKTYSVQLKLYDDKQASLGLVGTHNGQIGkDPNRDILIASNWYFNHLKDKILGCDWYFVPTDEGWTNDgggSGG*DIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS* |
| 131 | rTT_degly-K20-Fer | MKNLDCWVDkEEDIDVILKKSTILNLDINkDIISDISkFNSAVITYPDAQLVPGINGKAIHLVNNEkSEVIVHKAMkIEYNDMFNNFTVSFWLRVPKVSASHLEQYGTNEYSIISSMKKHkkSIGSGWSVSLKGNNLIWTLKDSkGEVRQITFRDLPkKFNAYLANKWVFITITNDRKSSANLYINGVLMGSAEITkLGAIREDNQITLKLDRCkNNNQYVSIDKFRIFCKALNPKEIEKLYTSYLSITFLRDFWGNPLRYDTEYYLIPVASSSKDVQLKQITDYMYLTkAPSYTNGKLNIYYRRLYNGLKFIIKRYkPNNkIDSFVKSGDFIKLYVSYkNNEHIVGYPKDGNAFNkLDRILRVGYkAPkIPLYKKMEAVKLRDLKTYSVQLKLYDDKQASLGLVGTHNGQIGkDPNRDILIASNWYFNHLKDKILGCDWYFVPTDEGWTNDgggSGG*DIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS* |
| 132 | rTT_degly-K20-ln15-Fer | MKNLDCWVDkEEDIDVILKKSTILNLDINkDIISDISkFNSAVITYPDAQLVPGINGKAIHLVNNEkSEVIVHKAMkIEYNDMFNNFTVSFWLRVPKVSASHLEQYGTNEYSIISSMKKHkkSIGSGWSVSLKGNNLIWTLKDSkGEVRQITFRDLPkKFNAYLANKWVFITITNDRkSSANLYINGVLMGSAEITkLGAIREDNQITLKLDRCkNNNQYVSIDKFRIFCKALNPKEIEKLYTSYLSITFLRDFWGNPLRYDTEYYLIPVASSSKDVQLKQITDYMYLTkAPSYTNGKLNIYYRRLYNGLKFIIKRYkPNNkIDSFVKSGDFIKLYVSYkNNEHIVGYPKDGNAFNkLDRILRVGYkAPkIPLYKKMEAVKLRDLKTYSVQLKLYDDKQASLGLVGTHNGQIGkDPNRDILIASNWYFNHLKDKILGCDWYFVPTDEGWTNDgggSGGggsggSGGg*DIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS* |
| 133 | rTT_degly-K20-ln25-Fer | MKNLDCWVDkEEDIDVILKKSTILNLDINkDIISDISkFNSAVITYPDAQLVPGINGKAIHLVNNEkSEVIVHKAMkIEYNDMFNNFTVSFWLRVPKVSASHLEQYGTNEYSIISSMKKHkkSIGSGWSVSLKGNNLIWTLKDSkGEVRQITFRDLPkKFNAYLANKWVFITITNDRkSSANLYINGVLMGSAEITkLGAIREDNQITLKLDRCkNNNQYVSIDKFRIFCKALNPKEIEKLYTSYLSITFLRDFWGNPLRYDTEYYLIPVASSSKDVQLKQITDYMYLTkAPSYTNGKLNIYYRRLYNGLKFIIKRYkPNNkIDSFVKSGDFIKLYVSYkNNEHIVGYPKDGNAFNkLDRILRVGYkAPkIPLYKKMEAVKLRDLKTYSVQLKLYDDKQASLGLVGTHNGQIGkDPNRDILIASNWYFNHLKDKILGCDWYFVPTDEGWTNDgggSGGggsggSGGggSGGggSGGg*DIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS* |
| 134 | rTT_degly-K20-ln35-Fer | MKNLDCWVDkEEDIDVILKKSTILNLDINkDIISDISkFNSAVITYPDAQLVPGINGKAIHLVNNEkSEVIVHKAMkIEYNDMFNNFTVSFWLRVPKVSASHLEQYGTNEYSIISSMKKHkkSIGSGWSVSLKGNNLIWTLKDSkGEVRQITFRDLPkKFNAYLANKWVFITITNDRkSSANLYINGVLMGSAEITkLGAIREDNQITLKLDRCkNNNQYVSIDKFRIFCKALNPKEIEKLYTSYLSITFLRDFWGNPLRYDTEYYLIPVASSSKDVQLKQITDYMYLTkAPSYTNGKLNIYYRRLYNGLKFIIKRYkPNNkIDSFVKSGDFIKLYVSYkNNEHIVGYPKDGNAFNkLDRILRVGYkAPkIPLYKKMEAVKLRDLKTYSVQLKLYDDKQASLGLVGTHNGQIGkDPNRDILIASNWYFNHLKDKILGCDWYFVPTDEGWTNDgggSGGggsggSGGggSGGggSGGggSGGggSGGg*DIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS* |
| 135 | rTT_degly-r8-Ferr | MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDggaeaaakeaaakeaaakeaaakaleaeaaakeaaakeaaakeaaaka*DIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS* |

TABLE 1-continued

Exemplary sequences of fusion proteins containing a protein nanoparticle subunit fused to a heterologous carrier protein and optionally a heterologous T-cell helper epitope.

| SEQ ID NO | Name | Sequence |
|---|---|---|
| 136 | rTT_degly-12pa-Ferr | MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDgsapapapapapapapapapapapapa*DIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS* |
| 137 | rTT_degly-r3-Ferr | MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDggaeaaakeaaakeaaaka*DIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS* |
| 138 | rTT_degly-3f-Ferr | MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDggggsggggsggggs*DIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS* |
| 139 | rTT_degly-2rf-Ferr | MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDgsaeaaakeaaaka*DIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS* |
| 140 | rTT_degly-5ga-Ferr | MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDgsgsgsgsgsasg*DIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS* |
| 141 | rTT_degly-1rf-Ferr | MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDpapapasg*DIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS* |

TABLE 1-continued

Exemplary sequences of fusion proteins containing a protein nanoparticle subunit fused to a heterologous carrier protein and optionally a heterologous T-cell helper epitope.

| SEQ ID NO | Name | Sequence |
|---|---|---|
| 142 | Ferr_deltaCT1-linker-rTT | *DIIKLLNEQVNKEMNSSNLYMSMSSWCYTHSLDGAGLFLFDHAAEEYEHAKKLIIFLNENNV PVQLTSISAPEHKFEGLTQIFQKAYEHEQHISESINNIVDHAIKSKDHATFNFLQWYVAEQH EEEVLFKDILDKIELIG*KALEAQKQKMKNLDCWVDNEEDIDVILKKSTILNLDINNDIISDI SGFNSSVITYPDAQLVPGINGKAIHLVNNESSEVIVHKAMDIEYNDMFNNFTVSFWLRVPKV SASHLEQYGTNEYSIISSMKKHSLSIGSGWSVSLKGNNLIWTLKDSAGEVRQITFRDLPDKF NAYLANKWVFITITNDRLSSANLYINGVLMGSAEITGLGAIREDNNITLKLDRCNNNNQYVS IDKFRIFCKALNPKEIEKLYTSYLSITFLRDFWGNPLRYDTEYYLIPVASSSKDVQLKNITD YMYLTNAPSYTNGKLNIYYRRLYNGLKFIIKRYTPNNEIDSFVKSGDFIKLYVSYNNNEHIV GYPKDGNAFNNLDRILRVGYNAPGIPLYKKMEAVKLRDLKTYSVQLKLYDDKNASLGLVGTH NGQIGNDPNRDILIASNWYFNHLKDKILGCDWYFVPTDEGWTND |
| 143 | Ferr_deltaCT2-linker-rTT | *DIIKLLNEQVNKEMNSSNLYMSMSSWCYTHSLDGAGLFLFDHAAEEYEHAKKLIIFLNENNV PVQLTSISAPEHKFEGLTQIFQKAYEHEQHISESINNIVDHAIKSKDHATFNFLQWYVAEQH EEEVLFKDILDKIELIGNEN*KALEAQKQKMKNLDCWVDNEEDIDVILKKSTILNLDINNDII SDISGFNSSVITYPDAQLVPGINGKAIHLVNNESSEVIVHKAMDIEYNDMFNNFTVSFWLRV PKVSASHLEQYGTNEYSIISSMKKHSLSIGSGWSVSLKGNNLIWTLKDSAGEVRQITFRDLP DKFNAYLANKWVFITITNDRLSSANLYINGVLMGSAEITGLGAIREDNNITLKLDRCNNNNQ YVSIDKFRIFCKALNPKEIEKLYTSYLSITFLRDFWGNPLRYDTEYYLIPVASSSKDVQLKN ITDYMYLTNAPSYTNGKLNIYYRRLYNGLKFIIKRYTPNNEIDSFVKSGDFIKLYVSYNNNE HIVGYPKDGNAFNNLDRILRVGYNAPGIPLYKKMEAVKLRDLKTYSVQLKLYDDKNASLGLV GTHNGQIGNDPNRDILIASNWYFNHLKDKILGCDWYFVPTDEGWTND |
| 144 | rTT-linker-Ferr | MKNLDCWVDNEEDIDVILKKSTILNLDINNDIISDISGFNSSVITYPDAQLVPGINGKAIHL VNNESSEVIVHKAMDIEYNDMFNNFTVSFWLRVPKVSASHLEQYGTNEYSIISSMKKHSLSI GSGWSVSLKGNNLIWTLKDSAGEVRQITFRDLPDKFNAYLANKWVFITITNDRLSSANLYIN GVLMGSAEITGLGAIREDNNITLKLDRCNNNNQYVSIDKFRIFCKALNPKEIEKLYTSYLSI TFLRDFWGNPLRYDTEYYLIPVASSSKDVQLKNITDYMYLTNAPSYTNGKLNIYYRRLYNGL KFIIKRYTPNNEIDSFVKSGDFIKLYVSYNNNEHIVGYPKDGNAFNNLDRILRVGYNAPGIP LYKKMEAVKLRDLKTYSVQLKLYDDKNASLGLVGTHNGQIGNDPNRDILIASNWYFNHLKDK ILGCDWYFVPTDEGWTNDKALEAQKQKSKD*IIKLLNEQVNKEMNSSNLYMSMSSWCYTHSLD GAGLFLFDHAAEEYEHAKKLIIFLNENNVPVQLTSISAPEHKFEGLTQIFQKAYEHEQHISE SINNIVDHAIKSKDHATFNFLQWYVAEQHEEEVLFKDILDKIELIGNENHGLYLADQYVKGI AKSRKS* |
| 145 | rTT-2xlinker-Ferr | MKNLDCWVDNEEDIDVILKKSTILNLDINNDIISDISGFNSSVITYPDAQLVPGINGKAIHL VNNESSEVIVHKAMDIEYNDMFNNFTVSFWLRVPKVSASHLEQYGTNEYSIISSMKKHSLSI GSGWSVSLKGNNLIWTLKDSAGEVRQITFRDLPDKFNAYLANKWVFITITNDRLSSANLYIN GVLMGSAEITGLGAIREDNNITLKLDRCNNNNQYVSIDKFRIFCKALNPKEIEKLYTSYLSI TFLRDFWGNPLRYDTEYYLIPVASSSKDVQLKNITDYMYLTNAPSYTNGKLNIYYRRLYNGL KFIIKRYTPNNEIDSFVKSGDFIKLYVSYNNNEHIVGYPKDGNAFNNLDRILRVGYNAPGIP LYKKMEAVKLRDLKTYSVQLKLYDDKNASLGLVGTHNGQIGNDPNRDILIASNWYFNHLKDK ILGCDWYFVPTDEGWTNDKALEAQKQKKALEAQKQKSKD*IIKLLNEQVNKEMNSSNLYMSMS SWCYTHSLDGAGLFLFDHAAEEYEHAKKLIIFLNENNVPVQLTSISAPEHKFEGLTQIFQKA YEHEQHISESINNIVDHAIKSKDHATFNFLQWYVAEQHEEEVLFKDILDKIELIGNENHGLY LADQYVKGIAKSRKS* |
| 146 | Ferr_deltaCT1-linker-CRM | *DIIKLLNEQVNKEMNSSNLYMSMSSWCYTHSLDGAGLFLFDHAAEEYEHAKKLIIFLNENNV PVQLTSISAPEHKFEGLTQIFQKAYEHEQHISESINNIVDHAIKSKDHATFNFLQWYVAEQH EEEVLFKDILDKIELIG*KALEAQKQKGADDVVDSSKSFVMENFSSYHGTKPGYVDSIQKGIQ KPKSGTQGNYDDDWKEFYSTDNKYDAAGYSVDNENPLSGKAGGVVKVTYPGLTKVLALKVDN AETIKKELGLSLTEPLMEQVGTEEFIKRFGDGASRVVLSLPFAEGSSSVEYINNWEQAKALS VELEINFETRGKRGQDAMYEYMAQACAGNRVRRSVGSSLSCINLDWDVIRDKTKTKIESLKE HGPIKNKMSESPNKTVSEEKAKQYLEEFHQTALEHPELSELKTVTGTNPVFAGANYAAWAVN VAQVIDSETADNLEKTTAALSILPGIGSVMGIADGAVHHNTEEIVAQSIALSSLMVAQAIPL VGELVDIGFAAYNFVESIINLFQVVHNSYNRPAYSPGHKTQPFLHDGYAVSWNTVEDSIIRT GFQGESGHDIKITAENTPLPIAGVLLPTIPGKLDVNKSKTHISVNGRKIRMRCRAIDGDVTF CRPKSPVYVGNGVHANLHVAFHRSSSEKIHSNEISSDSIGVLGYQKTVDHTKVNSKLSLFFE IKS |
| 147 | Ferr_deltaCT2-linker-CRM | *DIIKLLNEQVNKEMNSSNLYMSMSSWCYTHSLDGAGLFLFDHAAEEYEHAKKLIIFLNENNV PVQLTSISAPEHKFEGLTQIFQKAYEHEQHISESINNIVDHAIKSKDHATFNFLQWYVAEQH EEEVLFKDILDKIELIGNEN*KALEAQKQKGADDVVDSSKSFVMENFSSYHGTKPGYVDSIQK GIQKPKSGTQGNYDDDWKEFYSTDNKYDAAGYSVDNENPLSGKAGGVVKVTYPGLTKVLALK VDNAETIKKELGLSLTEPLMEQVGTEEFIKRFGDGASRVVLSLPFAEGSSSVEYINNWEQAK ALSVELEINFETRGKRGQDAMYEYMAQACAGNRVRRSVGSSLSCINLDWDVIRDKTKTKIES LKEHGPIKNKMSESPNKTVSEEKAKQYLEEFHQTALEHPELSELKTVTGTNPVFAGANYAAW AVNVAQVIDSETADNLEKTTAALSILPGIGSVMGIADGAVHHNTEEIVAQSIALSSLMVAQA IPLVGELVDIGFAAYNFVESIINLFQVVHNSYNRPAYSPGHKTQPFLHDGYAVSWNTVEDSI IRTGFQGESGHDIKITAENTPLPIAGVLLPTIPGKLDVNKSKTHISVNGRKIRMRCRAIDGD VTFCRPKSPVYVGNGVHANLHVAFHRSSSEKIHSNEISSDSIGVLGYQKTVDHTKVNSKLSL FFEIKS |

TABLE 1-continued

Exemplary sequences of fusion proteins containing a protein nanoparticle subunit fused to a heterologous carrier protein and optionally a heterologous T-cell helper epitope.

| SEQ ID NO | Name | Sequence |
|---|---|---|
| 148 | CRM-linker-Ferr | GADDVVDSSKSFVMENFSSYHGTKPGYVDSIQKGIQKPKSGTQGNYDDDWKEFYSTDNKYDA AGYSVDNENPLSGKAGGVVKVTYPGLTKVLALKVDNAETIKKELGLSLTEPLMEQVGTEEFI KRFGDGASRVVLSLPFAEGSSSVEYINNWEQAKALSVELEINFETRGKRGQDAMYEYMAQAC AGNRVRRSVGSSLSCINLDWDVIRDKTKTKIESLKEHGPIKNKMSESPNKTVSEEKAKQYLE EFHQTALEHPELSELKTVTGTNPVFAGANYAAWAVNVAQVIDSETADNLEKTTAALSILPGI GSVMGIADGAVHHNTEEIVAQSIALSSLMVAQAIPLVGELVDIGFAAYNFVESIINLFQVVH NSYNRPAYSPGHKTQPFLHDGYAVSWNTVEDSIIRTGFQGESGHDIKITAENTPLPIAGVLL PTIPGKLDVNKSKTHISVNGRKIRMRCRAIDGDVTFCRPKSPVYVGNGVHANLHVAFHRSSS EKIHSNEISSDSIGVLGYQKTVDHTKVNSKLSLFFEIKSKALEAQKQKSKDIIKLLNEQVNK EMNSSNLYMSMSSWCYTHSLDGAGLFLFDHAAEEYEHAKKLIIFLNENNVPVQLTSISAPEH KFEGLTQIFQKAYEHEQHISESINNIVDHAIKSKDHATFNFLQWYVAEQHEEEVLFKDILDK IELIGNENHGLYLADQYVKGIAKSRKS |
| 149 | CRM-2xlinker-Ferr | GADDVVDSSKSFVMENFSSYHGTKPGYVDSIQKGIQKPKSGTQGNYDDDWKEFYSTDNKYDA AGYSVDNENPLSGKAGGVVKVTYPGLTKVLALKVDNAETIKKELGLSLTEPLMEQVGTEEFI KRFGDGASRVVLSLPFAEGSSSVEYINNWEQAKALSVELEINFETRGKRGQDAMYEYMAQAC AGNRVRRSVGSSLSCINLDWDVIRDKTKTKIESLKEHGPIKNKMSESPNKTVSEEKAKQYLE EFHQTALEHPELSELKTVTGTNPVFAGANYAAWAVNVAQVIDSETADNLEKTTAALSILPGI GSVMGIADGAVHHNTEEIVAQSIALSSLMVAQAIPLVGELVDIGFAAYNFVESIINLFQVVH NSYNRPAYSPGHKTQPFLHDGYAVSWNTVEDSIIRTGFQGESGHDIKITAENTPLPIAGVLL PTIPGKLDVNKSKTHISVNGRKIRMRCRAIDGDVTFCRPKSPVYVGNGVHANLHVAFHRSSS EKIHSNEISSDSIGVLGYQKTVDHTKVNSKLSLFFEIKSKALEAQKQKKALEAQKQKSKDII KLLNEQVNKEMNSSNLYMSMSSWCYTHSLDGAGLFLFDHAAEEYEHAKKLIIFLNENNVPVQ LTSISAPEHKFEGLTQIFQKAYEHEQHISESINNIVDHAIKSKDHATFNFLQWYVAEQHEEE VLFKDILDKIELIGNENHGLYLADQYVKGIAKSRKS |
| 150 | rTT-ferr 1 | NLDCWVDNEEDIDVILKKSTILNLDINNDIISDISGFNS*AVITYPDAQLVPGINGKAIHLVN NEASEVIVHKAMDIEYNDMFNQ*FTVSFWLRVPKVSASHLEQYGTNEYSIISSMKKHSLSIGS GWSVSLKGNNLIWTLKDSAGEVRQITFRDLPDKFNAYLANKWVFITITNDRLSSANLYINGV LMGSAEITGLGAIREDNQITLKLDRCNNNNQYVSIDKFRIFCKALNPKEIEKLYTSYLSITF LRDFWGNPLRYDTEYYLIPVASSSKDVQLKQITDYMYLTNAPSYTNGKLNIYYRRLYNGLKF IIKRYTPNNEIDSFVKSGDFIKLYVSYNNNEHIVGYPKDGNAFNNLDRILRVGYNAPGIPLY KKMEAVKLRDLKTYSVQLKLYDDKNASLGLVGTHNGQIGNDPNRDILIASNWYFNHLKDKIL GaDWYFVPTDEGWTNDggsgggsgg*ASISEKMVEALNRQINAEIYSAYLYLSMASYFDSIGL KGFSNWMRVQWQEELMHAMKMFDFVSRRGGRVKLYAVEEPPSEWDSPLAAFEHVYEHEVNVV KRIHELVEMAMQEKDFATYNFLQWYVAEQVEEEASALDIVEKLRLIGEDKRALLFLDKELSL RQFTPPAEEEK* |

DNA starvation/stationary phase protection protein (DPS)

| 151 | dps(te)-rTT 1 | *SATTTLKEQVLTTLKREQANAVVMYLNYKKYHWLTYGPLFRDLHLLFEEQGSEVFAMIDELA ERSLMLDGQPVADPADYLKVATVTPSSGQLTVKQMIEEAIANHELIITEMHQDAEIATEAGD IGTADLYTRLVQTHQKHRWFLKEFLAKGDGLVS*ggsgggsggKNLDCWVDNEEDIDVILKKS TILNLDINNDIISDISGFNS*AVITYPDAQLVPGINGKAIHLVNNEASEVIVHKAMDIEYNDM FNQ*FTVSFWLRVPKVSASHLEQYGTNEYSIISSMKKHSLSIGSGWSVSLKGNNLIWTLKDSA GEVRQITFRDLPDKFNAYLANKWVFITITNDRLSSANLYINGVLMGSAEITGLGAIREDNQI TLKLDRCNNNNQYVSIDKFRIFCKALNPKEIEKLYTSYLSITFLRDFWGNPLRYDTEYYLIP VASSSKDVQLKQITDYMYLTNAPSYTNGKLNIYYRRLYNGLKFIIKRYTPNNEIDSFVKSGD FIKLYVSYNNNEHIVGYPKDGNAFNNLDRILRVGYNAPGIPLYKKMEAVKLRDLKTYSVQLK LYDDKNASLGLVGTHNGQIGNDPNRDILIASNWYFNHLKDKILGCDWYFVPTDEGWTND |
| 152 | dps(te)-rTT 2 | *SATTTLKEQVLTTLKREQANAVVMYLNYKKYHWLTYGPLFRDLHLLFEEQGSEVFAMIDELA ERSLMLDGQPVADPADYLKVATVTPSSGQLTVKQMIEEAIANHELIITEMHQDAEIATEAGD IGTADLYTRLVQTHQKHRWFLKEFLAKGDGLVS*ggsgggsgggsggsgKNLDCWVDNEEDID VILKKSTILNLDINNDIISDISGFNS*AVITYPDAQLVPGINGKAIHLVNNEASEVIVHKAMD IEYNDMFNQ*FTVSFWLRVPKVSASHLEQYGTNEYSIISSMKKHSLSIGSGWSVSLKGNNLIW TLKDSAGEVRQITFRDLPDKFNAYLANKWVFITITNDRLSSANLYINGVLMGSAEITGLGAI REDNQITLKLDRCNNNNQYVSIDKFRIFCKALNPKEIEKLYTSYLSITFLRDFWGNPLRYDT EYYLIPVASSSKDVQLKQITDYMYLTNAPSYTNGKLNIYYRRLYNGLKFIIKRYTPNNEIDS FVKSGDFIKLYVSYNNNEHIVGYPKDGNAFNNLDRILRVGYNAPGIPLYKKMEAVKLRDLKT YSVQLKLYDDKNASLGLVGTHNGQIGNDPNRDILIASNWYFNHLKDKILGCDWYFVPTDEGW TND |
| 153 | dps(te)-rTT 3 | *SATTTLKEQVLTTLKREQANAVVMYLNYKKYHWLTYGPLFRDLHLLFEEQGSEVFAMIDELA ERSLMLDGQPVADPADYLKVATVTPSSGQLTVKQMIEEAIANHELIITEMHQDAEIATEAGD IGTADLYTRLVQTHQKHRWFLKEFLAKGDGLVS*ggdsggdgggdggdgKNLDCWVDNEEDID VILKKSTILNLDINNDIISDISGFNS*AVITYPDAQLVPGINGKAIHLVNNEASEVIVHKAMD IEYNDMFNQ*FTVSFWLRVPKVSASHLEQYGTNEYSIISSMKKHSLSIGSGWSVSLKGNNLIW TLKDSAGEVRQITFRDLPDKFNAYLANKWVFITITNDRLSSANLYINGVLMGSAEITGLGAI REDNQITLKLDRCNNNNQYVSIDKFRIFCKALNPKEIEKLYTSYLSITFLRDFWGNPLRYDT EYYLIPVASSSKDVQLKQITDYMYLTNAPSYTNGKLNIYYRRLYNGLKFIIKRYTPNNEIDS FVKSGDFIKLYVSYNNNEHIVGYPKDGNAFNNLDRILRVGYNAPGIPLYKKMEAVKLRDLKT YSVQLKLYDDKNASLGLVGTHNGQIGNDPNRDILIASNWYFNHLKDKILGCDWYFVPTDEGW TND |

TABLE 1-continued

Exemplary sequences of fusion proteins containing a protein nanoparticle subunit fused to a heterologous carrier protein and optionally a heterologous T-cell helper epitope.

|

TABLE 1-continued

Exemplary sequences of fusion proteins containing a protein nanoparticle subunit fused to a heterologous carrier protein and optionally a heterologous T-cell helper epitope.

| SEQ ID NO | Name | Sequence |
|---|---|---|
| | | LRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTNDggsgg*TTIHDVQTTGLTQDAVTGFDASSRLNAGLQEVLVDLTALHLQGKQAHWNIVGENWRDLHLQLDTLVEAARGFSDDVAERMRAVGGVPDARPQTVAASRIGDVGPDEIDTRACVEAIVALVRHTVDTIRRVHDPIDAEDPASADLLHAITLELEKQAWMIGSENRSPRRR* |
| 161 | rTT-dps(kr) 2 | NLDCWVDNEEDIDVILKKSTILNLDINNDIISDISGFNSAVITYPDAQLVPGINGKAIHLVNNEASEVIVHKAMDIEYNDMFNQFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTNDggsgggsgg*TTIHDVQTTGLTQDAVTGFDASSRLNAGLQEVLVDLTALHLQGKQAHWNIVGENWRDLHLQLDTLVEAARGFSDDVAERMRAVGGVPDARPQTVAASRIGDVGPDEIDTRACVEAIVALVRHTVDTIRRVHDPIDAEDPASADLLHAITLELEKQAWMIGSENRSPRRR* |
| 162 | dps(np)-rTT 1 | *SETQTLLRNFGNVYDNPVLLDRSVTAPVTEGFNVVLASFQALYLQYQKHHFVVEGSEFYSLHEFFNEAYNQVQDHIHEIGERLDGLGGVPVATFSKLAELTCFEQESEGVYSSRQMVENDLAAEQAIIGVIRRQAAQAESLGDRGTRYLYEKILLKTEERAYHLSHFLAKDSLTLGFVQAAQS*ggsggKNLDCWVDNEEDIDVILKKSTILNLDINNDIISDISGFNSAVITYPDAQLVPGINGKAIHLVNNEASEVIVHKAMDIEYNDMFNQFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDWTND |
| 163 | dps(np)-rTT 2 | *SETQTLLRNFGNVYDNPVLLDRSVTAPVTEGFNVVLASFQALYLQYQKHHFVVEGSEFYSLHEFFNEAYNQVQDHIHEIGERLDGLGGVPVATFSKLAELTCFEQESEGVYSSRQMVENDLAAEQAIIGVIRRQAAQAESLGDRGTRYLYEKILLKTEERAYHLSHFLAKDSLTLGFVQAAQS*ggsgggsggKNLDCWVDNEEDIDVILKKSTILNLDINNDIISDISGFNSAVITYPDAQLVPGINGKAIHLVNNEASEVIVHKAMDIEYNDMFNQFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND |
| 164 | dps(np)-rTT 3 | *SETQTLLRNFGNVYDNPVLLDRSVTAPVTEGFNVVLASFQALYLQYQKHHFVVEGSEFYSLHEFFNEAYNQVQDHIHEIGERLDGLGGVPVATFSKLAELTCFEQESEGVYSSRQMVENDLAAEQAIIGVIRRQAAQAESLGDRGTRYLYEKILLKTEERAYHLSHFLAKDSLTLGFVQAAQS*ggsgggsgggsggsgKNLDCWVDNEEDIDVILKKSTILNLDINNDIISDISGFNSAVITYPDAQLVPGINGKAIHLVNNEASEVIVHKAMDIEYNDMFNQFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND |
| 165 | rTT-dps(np) 1 | NLDCWVDNEEDIDVILKKSTILNLDINNDIISDISGFNSAVITYPDAQLVPGINGKAIHLVNNEASEVIVHKAMDIEYNDMFNQFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTNDggsgg*MSETQTLLRNFGNVYDNPVLLDRSVTAPVTEGFNVVLASFQALYLQYQKHHFVVEGSEFYSLHEFFNEAYNQVQDHIHEIGERLDGLGGVPVATFSKLAELTCFEQESEGVYSSRQMVENDLAAEQAIIGVIRRQAAQAESLGDRGTRYLYEKILLKTEERAYHLSHFLAKDSLTLGFVQAAQS* |
| 166 | rTT-dps(np) 2 | NLDCWVDNEEDIDVILKKSTILNLDINNDIISDISGFNSAVITYPDAQLVPGINGKAIHLVNNEASEVIVHKAMDIEYNDMFNQFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLY |

TABLE 1-continued

Exemplary sequences of fusion proteins containing a protein nanoparticle subunit fused to a heterologous carrier protein and optionally a heterologous T-cell helper epitope.

| SEQ ID NO | Name | Sequence |
|---|---|---|
| | | KKMEAVKLRDLKTYSVQLKLYDDKNASLGLVGTHNGQIGNDPNRDILIASNWYFNHLKDKILGCDWYFVPTDEGWTNDggsgggsgg*MSETQTLLRNFGNVYDNPVLLDRSVTAPVTEGFNVVLASFQALYLQYQKHHFVVEGSEFYSLHEFFNEAYNQVQDHIHEIGERLDGLGGVPVATFSKLAELTCFEQESEGVYSSRQMVENDLAAEQAIIGVIRRQAAQAESLGDRGTRYLYEKILLKTEERAYHLSHFLAKDSLTLGFVQAAQS* |
| | | Bacteriophage Q Beta Capsid, Chain A |
| 167 | rTT-qbeta 1 | NLDCWVDNEEDIDVILKKSTILNLDINNDIISDISGFNSAVITYPDAQLVPGINGKAIHLVNNEASEVIVHKAMDIEYNDMFNQFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTNDggsggsgsgg*AKLETVTLGNIGKDGKQTLVLNPRGVNPTNGVASLSQAGAVPALEKRVTVSVSQPSRNRKNYKVQVKIQNPTACTANG***A***CDPSVTRQAYADVTFSFTQYSTDEERAFVRTELAALLASPLLIDAIDQLNPAY* |
| 168 | rTT-qbeta 2 | NLDCWVDNEEDIDVILKKSTILNLDINNDIISDISGFNSAVITYPDAQLVPGINGKAIHLVNNEASEVIVHKAMDIEYNDMFNQFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTNDggdgssgdgg*AKLETVTLGNIGKDGKQTLVLNPRGVNPTNGVASLSQAGAVPALEKRVTVSVSQPSRNRKNYKVQVKIQNPTACTANG***A***CDPSVTRQAYADVTFSFTQYSTDEERAFVRTELAALLASPLLIDAIDQLNPAY* |
| 169 | rTT-qbeta 3 | NLDCWVDNEEDIDVILKKSTILNLDINNDIISDISGFNSAVITYPDAQLVPGINGKAIHLVNNEASEVIVHKAMDIEYNDMFNQFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTNDggsgggsgggsggsg*AKLETVTLGNIGKDGKQTLVLNPRGVNPTNGVASLSQAGAVPALEKRVTVSVSQPSRNRKNYKVQVKIQNPTACTANG***A***CDPSVTRQAYADVTFSFTQYSTDEERAFVRTELAALLASPLLIDAIDQLNPAY* |
| 170 | rTT-qbeta 4 | NLDCWVDNEEDIDVILKKSTILNLDINNDIISDISGFNSAVITYPDAQLVPGINGKAIHLVNNEASEVIVHKAMDIEYNDMFNQFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTNDggdsggdgggdggdg*AKLETVTLGNIGKDGKQTLVLNPRGVNPTNGVASLSQAGAVPALEKRVTVSVSQPSRNRKNYKVQVKIQNPTACTANG***A***CDPSVTRQAYADVTFSFTQYSTDEERAFVRTELAALLASPLLIDAIDQLNPAY* |
| 171 | rTT-qbeta 5 | NLDCWVDNEEDIDVILKKSTILNLDINNDIISDISGFNSAVITYPDAQLVPGINGKAIHLVNNEASEVIVHKAMDIEYNDMFNQFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTNDggsggppppgsggsg*AKLETVTLGNIGKDGKQTLVLNPRGVNPTNGVASLSQAGAVPALEKRVTVSVSQPSRNRKNYKVQVKIQNPTACTANG***A***CDPSVTRQAYADVTFSFTQYSTDEERAFVRTELAALLASPLLIDAIDQLNPAY* |
| | | CaMKIIa (12-mer) C-term fragment (5U6Y) |
| 172 | CRM-5U6Y 1 | GADDVVDSSKSFVMENFSSYHGTKPGYVDSIQKGIQKPKSGTQGNYDDDWKEFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKTQPFLHDGYAVSWNTVEDSIIRTGFQGESGHDIKITAENTPLPIAGVLLPTIPGKLDVNKSKTHISVNGRKIRMRCRAIDGDVTFCRPKSPVYVGNGVHANLHVAFHRSSSEKIHSNEISSDSIGVLGYQKTVDHTKVNSKLSLFFEIKS*ggksggnkksdgvkessestnta* |

TABLE 1-continued

Exemplary sequences of fusion proteins containing a protein nanoparticle subunit fused to a heterologous carrier protein and optionally a heterologous T-cell helper epitope.

| SEQ ID NO | Name | Sequence |
|---|---|---|
| | | *iededtkvrkqeiikvteqlieaisngdfesytkmcdpgmtafepealgnlvegldfhrfyf enlwsrnskpvhttilnphihlmgdesaciayiritqyldaggiprtaqseetrvwhrrdgk wqivhfhrsga* |
| 173 | CRM-5U6Y 2 | GADDVVDSSKSFVMENFSSYHGTKPGYVDSIQKGIQKPKSGTQGNYDDDWKEFYSTDNKYDA AGYSVDNENPLSGKAGGVVKVTYPGLTKVLALKVDNAETIKKELGLSLTEPLMEQVGTEEFI KRFGDGASRVVLSLPFAEGSSSVEYINNWEQAKALSVELEINFETRGKRGQDAMYEYMAQAC AGNRVRRSVGSSLSCINLDWDVIRDKTKTKIESLKEHGPIKNKMSESPNKTVSEEKAKQYLE EFHQTALEHPELSELKTVTGTNPVFAGANYAAWAVNVAQVIDSETADNLEKTTAALSILPGI GSVMGIADGAVHHNTEEIVAQSIALSSLMVAQAIPLVGELVDIGFAAYNFVESIINLFQVVH NSYNRPAYSPGHKTQPFLHDGYAVSWNTVEDSIIRTGFQGESGHDIKITAENTPLPIAGVLL PTIPGKLDVNKSKTHISVNGRKIRMRCRAIDGDVTFCRPKSPVYVGNGVHANLHVAFHRSSS EKIHSNEISSDSIGVLGYQKTVDHTKVNSKLSLFFEIKS*gvkessestntaiededtkvrkq eiikvteqlieaisngdfesytkmcdpgmtafepealgnlvegldfhrfyfenlwsrnskpv httilnphihlmgdesaciayiritqyldaggiprtaqseetrvwhrrdgkwqivhfhrsga* |
| 174 | CRM-5U6Y 3 | GADDVVDSSKSFVMENFSSYHGTKPGYVDSIQKGIQKPKSGTQGNYDDDWKEFYSTDNKYDA AGYSVDNENPLSGKAGGVVKVTYPGLTKVLALKVDNAETIKKELGLSLTEPLMEQVGTEEFI KRFGDGASRVVLSLPFAEGSSSVEYINNWEQAKALSVELEINFETRGKRGQDAMYEYMAQAC AGNRVRRSVGSSLSCINLDWDVIRDKTKTKIESLKEHGPIKNKMSESPNKTVSEEKAKQYLE EFHQTALEHPELSELKTVTGTNPVFAGANYAAWAVNVAQVIDSETADNLEKTTAALSILPGI GSVMGIADGAVHHNTEEIVAQSIALSSLMVAQAIPLVGELVDIGFAAYNFVESIINLFQVVH NSYNRPAYSPGHKTQPFLHDGYAVSWNTVEDSIIRTGFQGESGHDIKITAENTPLPIAGVLL PTIPGKLDVNKSKTHISVNGRKIRMRCRAIDGDVTFCRPKSPVYVGNGVHANLHVAFHRSSS EKIHSNEISSDSIGVLGYQKTVDHTKVNSKLSLFFEIKS*gstntaiededtkvrkqeiikvt eqlieaisngdfesytkmcdpgmtafepealgnlvegldfhrfyfenlwsrnskpvhttiln phihlmgdesaciayiritqyldaggiprtaqseetrvwhrrdgkwqivhfhsga* |
| 175 | HID-5U6Y 1 | SNMANTQMKSDKIIIAHRGASGYLPEHTLESKALAFAQQADYLEQDLAMTKDGRLVVIHDHF LDGLTDVAKKFPHRHRKDGRYYVIDFTLKEIQSLEMTENFETKDGKQAQVYPNRFPLWKSHF RIHTFEDEIEFIQGLEKSTGKKVGIYPEIKAPWFHHQNGKDIAAETLKVLKKYGYDKKTDMV YLQTFDFNELKRIKTELLPQMGMDLKLVQLIAYTDWKETQKEDPKGYWVNYNYDWMFKPGAM AEVVKYADGVGPGWYMLVNKEESKPDNIVYTPLVKELAQYNVEVHPYTVRKDALPEFFTDVN QMYDALLNKSGATGVFTDFPDTGVEFLKGIK*ggksggnkksdgvkessestntaiededtkv rkqeiikvteqlieaisngdfesytkmcdpgmtafepealgnlvegldfhrfyfenlwsrns kpvhttilnphihlmgdesaciayiritqyldaggiprtaqseetrvwhrrdgkwqivhfhr sga* |
| 176 | HID-5U6Y 2 | SNMANTQMKSDKIIIAHRGASGYLPEHTLESKALAFAQQADYLEQDLAMTKDGRLVVIHDHF LDGLTDVAKKFPHRHRKDGRYYVIDFTLKEIQSLEMTENFETKDGKQAQVYPNRFPLWKSHF RIHTFEDEIEFIQGLEKSTGKKVGIYPEIKAPWFHHQNGKDIAAETLKVLKKYGYDKKTDMV YLQTFDFNELKRIKTELLPQMGMDLKLVQLIAYTDWKETQEKDPKGYWVNYNYDWMFKPGAM AEVVKYADGVGPGWYMLVNKEESKPDNIVYTPLVKELAQYNVEVHPYTVRKDALPEFFTDVN QMYDALLNKSGATGVFTDFPDTGVEFLKGIK*gvkessestntaiededtkvrkqeiikvteq lieaisngdfesytkmcdpgmtafepealgnlvegldfhrfyfenlwsrnskpvhttilnph ihlmgdesaciayiritqyldaggiprtaqseetrvwhrrdgkwqivhnrsga* |
| 177 | HID-5U6Y 3 | SNMANTQMKSDKIIIAHRGASGYLPEHTLESKALAFAQQADYLEQDLAMTKDGRLVVIHDHF LDGLTDVAKKFPHRHRKDGRYYVIDFTLKEIQSLEMTENFETKDGKQAQVYPNRFPLWKSHF RIHTFEDEIEFIQGLEKSTGKKVGIYPEIKAPWFHHQNGKDIAAETLKVLKKYGYDKKTDMV YLQTFDFNELKRIKTELLPQMGMDLKLVQLIAYTDWKETQEKDPKGYWVNYNYDWMFKPGAM AEVVKYADGVGPGWYMLVNKEESKPDNIVYTPLVKELAQYNVEVHPYTVRKDALPEFFTDVN QMYDALLNKSGATGVFTDFPDTGVEFLKGIK*gstntaiededtkvrkqeiikvteqlieais ngdfesytkmcdpgmtafepealgnlvegldfhrfyfenlwsrnskpvhttilnphihlmgd esaciayiritqyldaggiprtaqseetrvwhrrdgkwqivhfhrsga* |
| | Phosphopantetheine Adenylyltransferase (6ccq) | |
| 178 | CRM-6CCQ-rTT | GADDVVDSSKSFVMENFSSYHGTKPGYVDSIQKGIQKPKSGTQGNYDDDWKEFYSTDNKYDA AGYSVDNENPLSGKAGGVVKVTYPGLTKVLALKVDNAETIKKELGLSLTEPLMEQVGTEEFI KRFGDGASRVVLSLPFAEGSSSVEYINNWEQAKALSVELEINFETRGKRGQDAMYEYMAQAC AGNRVRRSVGSSLSCINLDWDVIRDKTKTKIESLKEHGPIKNKMSESPNKTVSEEKAKQYLE EFHQTALEHPELSELKTVTGTNPVFAGANYAAWAVNVAQVIDSETADNLEKTTAALSILPGI GSVMGIADGAVHHNTEEIVAQSIALSSLMVAQAIPLVGELVDIGFAAYNFVESIINLFQVVH NSYNRPAYSPGHKTQPFLHDGYAVSWNTVEDSIIRTGFQGESGHDIKITAENTPLPIAGVLL PTIPGKLDVNKSKTHISVNGRKIRMRCRAIDGDVTFCRPKSPVYVGNGVHANLHVAFHRSSS EKIHSNEISSDSIGVLGYQKTVDHTKVNSKLSLFFEIKS*ggggsggggs*MQKRAIYPGTFDP ITNGHIDIVTRATQMFDHVILAIAASPSKKPMFTLEERVALAQQATAHLGNVEVVGFSDLMA NFARNQHATVLIRGLRAVADFEYEMQLAHMNRHLMPELESVFLMPSKEWSFISSSLVKEVAR HQGDVTHFLPENVHQALMAKLAV*Dggggsggggs*MKNLDCWVDNEEDIDVILKKSTILNLDI NNDIISDISGFNSSVITYPDAQLVPGINGKAIHLVNNESSEVIVHKAMDIEYNDMFNNFTVS FWLRVPKVSASHLEQYGTNEYSIISSMKKHSLSIGSGWSVSLKGNNLIWTLKDSAGEVRQIT FRDLPDKFNAYLANKWVFITITNDRLSSANLYINGVLMGSAEITGLGAIREDNNITLKLDRC NNNNQYVSIDKFRIFCKALNPKEIEKLYTSYLSITFLRDFWGNPLRYDTEYYLIPVASSSKD |

TABLE 1-continued

Exemplary sequences of fusion proteins containing a protein nanoparticle subunit fused to a heterologous carrier protein and optionally a heterologous T-cell helper epitope.

| SEQ ID NO | Name | Sequence |
|---|---|---|
| | | VQLKNITDYMYLTNAPSYTNGKLNIYYRRLYNGLKFIIKRYTPNNEIDSFVKSGDFIKLYVS YNNNEHIVGYPKDGNAFNNLDRILRVGYNAPGIPLYKKMEAVKLRDLKTYSVQLKLYDDKNA SLGLVGTHNGQIGNDPNRDILIASNWYFNHLKDKILGCDWYFVPTDEGWTND |
| 179 | HID-6CCQ-rTT | SNMANTQMKSDKIIIAHRGASGYLPEHTLESKALAFAQQADYLEQDLAMTKDGRLVVIHDHF LDGLTDVAKKFPHRHRKDGRYYVIDFTLKEIQSLEMTENFETKDGKQAQVYPNRFPLWKSHF RIHTFEDEIEFIQGLEKSTGKKVGIYPEIKAPWFHHQNGKDIAAETLKVLKKYGYDKKTDMV YLQTFDFNELKRIKTELLPQMGMDLKLVQLIAYTDWKETQEKDPKGYWVNYNYDWMFKPGAM AEVVKYADGVGPGWYMLVNKEESKPDNIVYTPLVKELAQYNVEVHPYTVRKDALPEFFTDVN QMYDALLNKSGATGVFTDFPDTGVEFLKGIKggggsggggs*MQKRAIYPGTFDPITNGHIDI VTRATQMFDHVILAIAASPSKKPMFTLEERVALAQQATAHLGNVEVVGFSDLMANFARNQHA TVLIRGLRAVADFEYEMQLAHMNRHLMPELESVFLMPSKEWSFISSSLVKEVARHQGDVTHF LPENVHQALMAKLAV*ddggggsggggsMKNLDCWVDNEEDIDVILKKSTILNLDINNDIISDI SGFNSSVITYPDAQLVPGINGKAIHLVNNESSEVIVHKAMDIEYNDMFNNFTVSFWLRVPKV SASHLEQYGTNEYSIISSMKKHSLSIGSGWSVSLKGNNLIWTLKDSAGEVRQITFRDLPDKF NAYLANKWVFITITNDRLSSANLYINGVLMGSAEITGLGAIREDNNITLKLDRCNNNNQYVS IDKFRIFCKALNPKEIEKLYTSYLSITFLRDFWGNPLRYDTEYYLIPVASSSKDVQLKNITD YMYLTNAPSYTNGKLNIYYRRLYNGLKFIIKRYTPNNEIDSFVKSGDFIKLYVSYNNNEHIV GYPKDGNAFNNLDRILRVGYNAPGIPLYKKMEAVKLRDLKTYSVQLKLYDDKNASLGLVGTH NGQIGNDPNRDILIASNWYFNHLKDKILGCDWYFVPTDEGWTND |
| | T4 fibritin Foldon domain (Fd) | |
| 180 | Fd-rTT_degly | *GYIPEAPRDGQAYVRKDGEWVLLSTFLGSGGGGQ*MKNLDCWVDNEEDIDVILKKSTILNLD INNDIISDISGFNSAVITYPDAQLVPGINGKAIHLVNNEASEVIVHKAMDIEYNDMFNNFTV SFWLRVPKVSASHLEQYGTNEYSIISSMKKHSLSIGSGWSVSLKGNNLIWTLKDSAGEVRQI TFRDLPDKFNAYLANKWVFITITNDRLSSANLYINGVLMGSAEITGLGAIREDNQITLKLDR CNNNNQYVSIDKFRIFCKALNPKEIEKLYTSYLSITFLRDFWGNPLRYDTEYYLIPVASSSK DVQLKQITDYMYLTNAPSYTNGKLNIYYRRLYNGLKFIIKRYTPNNEIDSFVKSGDFIKLYV SYNNNEHIVGYPKDGNAFNNLDRILRVGYNAPGIPLYKKMEAVKLRDLKTYSVQLKLYDDKQ ASLGLVGTHNGQIGNDPNRDILIASNWYFNHLKDKILGCDWYFVPTDEGWTND |
| 181 | rTT_degly-Fd-TT_degly | MKNLDCWVDNEEDIDVILKKSTILNLDINNDIISDISGFNSAVITYPDAQLVPGINGKAIHL VNNEASEVIVHKAMDIEYNDMFNNFTVSFWLRVPKVSASHLEQYGTNEYSIISSMKKHSLSI GSGWSVSLKGNNLIWTLKDSAGEVRQITFRDLPDKFNAYLANKWVFITITNDRLSSANLYIN GVLMGSAEITGLGAIREDNQITLKLDRCNNNNQYVSIDKFRIFCKALNPKEIEKLYTSYLSI TFLRDFWGNPLRYDTEYYLIPVASSSKDVQLKQITDYMYLTNAPSYTNGKLNIYYRRLYNGL KFIIKRYTPNNEIDSFVKSGDFIKLYVSYNNNEHIVGYPKDGNAFNNLDRILRVGYNAPGIP LYKKMEAVKLRDLKTYSVQLKLYDDKQASLGLVGTHNGQIGNDPNRDILIASNWYFNHLKDK ILGCDWYFVPTDEGWTNDgg*GSGYIPEAPRDGQAYVRKDGEWVLLSTFLGSGGGGQ*MKNLD CWVDNEEDIDVILKKSTILNLDINNDIISDISGFNSAVITYPDAQLVPGINGKAIHLVNNEA SEVIVHKAMDIEYNDMFNNFTVSFWLRVPKVSASHLEQYGTNEYSIISSMKKHSLSIGSGWS VSLKGNNLIWTLKDSAGEVRQITFRDLPDKFNAYLANKWVFITITNDRLSSANLYINGVLMG SAEITGLGAIREDNQITLKLDRCNNNNQYVSIDKFRIFCKALNPKEIEKLYTSYLSITFLRD FWGNPLRYDTEYYLIPVASSSKDVQLKQITDYMYLTNAPSYTNGKLNIYYRRLYNGLKFIIK RYTPNNEIDSFVKSGDFIKLYVSYNNNEHIVGYPKDGNAFNNLDRILRVGYNAPGIPLYKKM EAVKLRDLKTYSVQLKLYDDKQASLGLVGTHNGQIGNDPNRDILIASNWYFNHLKDKILGCD WYFVPTDEGWTND |
| 182 | Fd-rTT_degly-K20 | *GYIPEAPRDGQAYVRKDGEWVLLSTFLGSGGGGQ*MKNLDCWVDkEEDIDVILKKSTILNLD INkDIISDISkFNSAVITYPDAQLVPGINGKAIHLVNNEkSEVIVHKAMkIEYNDMFNNFTV SFWLRVPKVSASHLEQYGTNEYSIISSMKKHkkSIGSGWSVSLKGNNLIWTLKDSkGEVRQI TFRDLPkKFNAYLANKWVFITITNDRkSSANLYINGVLMGSAEITkLGAIREDNQITLKLDR CkNNNNQYVSIDKFRIFCKALNPKEIEKLYTSYLSITFLRDFWGNPLRYDTEYYLIPVASSSK DVQLKQITDYMYLTkAPSYTNGKLNIYYRRLYNGLKFIIKRYkPNNkIDSFVKSGDFIKLYV SYkNNEHIVGYPKDGNAFNkLDRILRVGYkAPkIPLYKKMEAVKLRDLKTYSVQLKLYDDKQ ASLGLVGTHNGQIGkDPNRDILIASNWYFNHLKDKILGCDWYFVPTDEGWTND |
| 183 | rTT_degly-Fd-TT_degly-K20 | MKNLDCWVDkEEDIDVILKKSTILNLDINkDIISDISkFNSAVITYPDAQLVPGINGKAIHL VNNEkSEVIVHKAMkIEYNDMFNNFTVSFWLRVPKVSASHLEQYGTNEYSIISSMKKHkkSI GSGWSVSLKGNNLIWTLKDSkGEVRQITFRDLPkKFNAYLANKWVFITITNDRkSSANLYIN GVLMGSAEITkLGAIREDNQITLKLDRCkNNNNQYVSIDKFRIFCKALNPKEIEKLYTSYLSI TFLRDFWGNPLRYDTEYYLIPVASSSKDVQLKQITDYMYLTkAPSYTNGKLNIYYRRLYNGL KFIIKRYkPNNkIDSFVKSGDFIKLYVSYkNNEHIVGYPKDGNAFNkLDRILRVGYkAPkIP LYKKMEAVKLRDLKTYSVQLKLYDDKQASLGLVGTHNGQIGkDPNRDILIASNWYFNHLKDK ILGCDWYFVPTDEGWTNDgg*GSGYIPEAPRDGQAYVRKDGEWVLLSTFLGSGGGGQ*MKNLD CWVDkEEDIDVILKKSTILNLDINkDIISDISkFNSAVITYPDAQLVPGINGKAIHLVNNEk SEVIVHKAMkIEYNDMFNNFTVSFWLRVPKVSASHLEQYGTNEYSIISSMKKHkkSIGSGWS VSLKGNNLIWTLKDSkGEVRQITFRDLPkKFNAYLANKWVFITITNDRkSSANLYINGVLMG |

TABLE 1-continued

Exemplary sequences of fusion proteins containing a protein nanoparticle subunit fused to a heterologous carrier protein and optionally a heterologous T-cell helper epitope.

| SEQ ID NO | Name | Sequence |
|---|---|---|
| | | SAEITkLGAIREDNQITLKLDRCkNNNQYVSIDKFRIFCKALNPKEIEKLYTSYLSITFLRD FWGNPLRYDTEYYLIPVASSSKDVQLKQITDYMYLTkAPSYTNGKLNIYYRRLYNGLKFIIK RYkPNNkIDSFVKSGDFIKLYVSYkNNEHIVGYPKDGNAFNkLDRILRVGYkAPkIPLYKKM EAVKLRDLKTYSVQLKLYDDKQASLGLVGTHNGQIGkDPNRDILIASNWYFNHLKDKILGCD WYFVPTDEGWTND |

Hexamer

| 184 | rTT_degly-r8_linker-Fc-Hexamer | MKNLDCWVDNEEDIDVILKKSTILNLDINNDIISDISGFNSAVITYPDAQLVPGINGKAIHL VNNEASEVIVHKAMDIEYNDMFNNFTVSFWLRVPKVSASHLEQYGTNEYSIISSMKKHSLSI GSGWSVSLKGNNLIWTLKDSAGEVRQITFRDLPDKFNAYLANKWVFITITNDRLSSANLYIN GVLMGSAEITGLGAIREDNQITLKLDRCNNNQYVSIDKFRIFCKALNPKEIEKLYTSYLSI TFLRDFWGNPLRYDTEYYLIPVASSSKDVQLKQITDYMYLTNAPSYTNGKLNIYYRRLYNGL KFIIKRYTPNNEIDSFVKSGDFIKLYVSYNNNEHIVGYPKDGNAFNNLDRILRVGYNAPGIP LYKKMEAVKLRDLKTYSVQLKLYDDKQASLGLVGTHNGQIGNDPNRDILIASNWYFNHLKDK ILGCDWYFVPTDEGWTNDggaeaaakeaaakeaaakeaaakaleaeaaakeaaakeaaakea aakaEPKSCDKTHTCPKCPAPELLGGPSVFLFPPKPKDTLMISRTPEVTCVVVDVSHEDPEV KFNWYVDGVEVHNAKTKPREEQYNSTYRVVSVLTVCLQDWLNGKEYKCKVSNKALPAPIEKT ISKAKGQPREPQVYTLPPSRDELTKNQVSLTCLVKGFYPSDIAVEWESNGQPENNYKTTPPV LDSDGSFFLYSKLTVDKSRWQQGNVFSCSVMHEALHNHYTQKSLSLSPGKggsgg*PTLYNVS LVMSDTAGTCY* |
| 185 | rTT_degly-12pa_linker-Fc-Hexamer | MKNLDCWVDNEEDIDVILKKSTILNLDINNDIISDISGFNSAVITYPDAQLVPGINGKAIHL VNNEASEVIVHKAMDIEYNDMFNNFTVSFWLRVPKVSASHLEQYGTNEYSIISSMKKHSLSI GSGWSVSLKGNNLIWTLKDSAGEVRQITFRDLPDKFNAYLANKWVFITITNDRLSSANLYIN GVLMGSAEITGLGAIREDNQITLKLDRCNNNQYVSIDKFRIFCKALNPKEIEKLYTSYLSI TFLRDFWGNPLRYDTEYYLIPVASSSKDVQLKQITDYMYLTNAPSYTNGKLNIYYRRLYNGL KFIIKRYTPNNEIDSFVKSGDFIKLYVSYNNNEHIVGYPKDGNAFNNLDRILRVGYNAPGIP LYKKMEAVKLRDLKTYSVQLKLYDDKQASLGLVGTHNGQIGNDPNRDILIASNWYFNHLKDK ILGCDWYFVPTDEGWTNDgspapapapapapapapapapapapapaEPKSCDKTHTCPKCPAPE LLGGPSVFLFPPKPKDTLMISRTPEVTCVVVDVSHEDPEVKFNWYVDGVEVHNAKTKPREEQ YNSTYRVVSVLTVCLQDWLNGKEYKCKVSNKALPAPIEKTISKAKGQPREPQVYTLPPSRDE LTKNQVSLTCLVKGFYPSDIAVEWESNGQPENNYKTTPPVLDSDGSFFLYSKLTVDKSRWQQ GNVFSCSVMHEALHNHYTQKSLSLSPGKggsgg*PTLYNVSLVMSDTAGTCY* |
| 186 | rTT_degly-r3_linker-Fc-Hexamer | MKNLDCWVDNEEDIDVILKKSTILNLDINNDIISDISGFNSAVITYPDAQLVPGINGKAIHL VNNEASEVIVHKAMDIEYNDMFNNFTVSFWLRVPKVSASHLEQYGTNEYSIISSMKKHSLSI GSGWSVSLKGNNLIWTLKDSAGEVRQITFRDLPDKFNAYLANKWVFITITNDRLSSANLYIN GVLMGSAEITGLGAIREDNQITLKLDRCNNNQYVSIDKFRIFCKALNPKEIEKLYTSYLSI TFLRDFWGNPLRYDTEYYLIPVASSSKDVQLKQITDYMYLTNAPSYTNGKLNIYYRRLYNGL KFIIKRYTPNNEIDSFVKSGDFIKLYVSYNNNEHIVGYPKDGNAFNNLDRILRVGYNAPGIP LYKKMEAVKLRDLKTYSVQLKLYDDKQASLGLVGTHNGQIGNDPNRDILIASNWYFNHLKDK ILGCDWYFVPTDEGWTNDggaeaaakeaaakeaaakaEPKSCDKTHTCPKCPAPELLGGPSV FLFPPKPKDTLMISRTPEVTCVVVDVSHEDPEVKFNWYVDGVEVHNAKTKPREEQYNSTYRV VSVLTVCLQDWLNGKEYKCKVSNKALPAPIEKTISKAKGQPREPQVYTLPPSRDELTKNQVS LTCLVKGFYPSDIAVEWESNGQPENNYKTTPPVLDSDGSFFLYSKLTVDKSRWQQGNVFSCS VMHEALHNHYTQKSLSLSPGKggsgg*PTLYNVSLVMSDTAGTCY* |
| 187 | rTT_degly-5gA_linker-Fc-Hexamer | MKNLDCWVDNEEDIDVILKKSTILNLDINNDIISDISGFNSAVITYPDAQLVPGINGKAIHL VNNEASEVIVHKAMDIEYNDMFNNFTVSFWLRVPKVSASHLEQYGTNEYSIISSMKKHSLSI GSGWSVSLKGNNLIWTLKDSAGEVRQITFRDLPDKFNAYLANKWVFITITNDRLSSANLYIN GVLMGSAEITGLGAIREDNQITLKLDRCNNNQYVSIDKFRIFCKALNPKEIEKLYTSYLSI TFLRDFWGNPLRYDTEYYLIPVASSSKDVQLKQITDYMYLTNAPSYTNGKLNIYYRRLYNGL KFIIKRYTPNNEIDSFVKSGDFIKLYVSYNNNEHIVGYPKDGNAFNNLDRILRVGYNAPGIP LYKKMEAVKLRDLKTYSVQLKLYDDKQASLGLVGTHNGQIGNDPNRDILIASNWYFNHLKDK ILGCDWYFVPTDEGWTNDgsgsgsgsgsasgasgEPKSCDKTHTCPKCPAPELLGGPSVFLF PPKPKDTLMISRTPEVTCVVVDVSHEDPEVKFNWYVDGVEVHNAKTKPREEQYNSTYRVVSV LTVCLQDWLNGKEYKCKVSNKALPAPIEKTISKAKGQPREPQVYTLPPSRDELTKNQVSLTC LVKGFYPSDIAVEWESNGQPENNYKTTPPVLDSDGSFFLYSKLTVDKSRWQQGNVFSCSVMH EALHNHYTQKSLSLSPGKggsgg*PTLYNVSLVMSDTAGTCY* |
| 188 | rTT_degly-3f_linker-Fc-Hexamer | MKNLDCWVDNEEDIDVILKKSTILNLDINNDIISDISGFNSAVITYPDAQLVPGINGKAIHL VNNEASEVIVHKAMDIEYNDMFNNFTVSFWLRVPKVSASHLEQYGTNEYSIISSMKKHSLSI GSGWSVSLKGNNLIWTLKDSAGEVRQITFRDLPDKFNAYLANKWVFITITNDRLSSANLYIN GVLMGSAEITGLGAIREDNQITLKLDRCNNNQYVSIDKFRIFCKALNPKEIEKLYTSYLSI TFLRDFWGNPLRYDTEYYLIPVASSSKDVQLKQITDYMYLTNAPSYTNGKLNIYYRRLYNGL KFIIKRYTPNNEIDSFVKSGDFIKLYVSYNNNEHIVGYPKDGNAFNNLDRILRVGYNAPGIP LYKKMEAVKLRDLKTYSVQLKLYDDKQASLGLVGTHNGQIGNDPNRDILIASNWYFNHLKDK ILGCDWYFVPTDEGWTNDggggsggggsggggsEPKSCDKTHTCPKCPAPELLGGPSVFLFP PKPKDTLMISRTPEVTCVVVDVSHEDPEVKFNWYVDGVEVHNAKTKPREEQYNSTYRVVSVL TVCLQDWLNGKEYKCKVSNKALPAPIEKTISKAKGQPREPQVYTLPPSRDELTKNQVSLTCL VKGFYPSDIAVEWESNGQPENNYKTTPPVLDSDGSFFLYSKLTVDKSRWQQGNVFSCSVMHE ALHNHYTQKSLSLSPGKggsgg*PTLYNVSLVMSDTAGTCY* |

TABLE 1-continued

Exemplary sequences of fusion proteins containing a protein nanoparticle subunit fused to a heterologous carrier protein and optionally a heterologous T-cell helper epitope.

| SEQ ID NO | Name | Sequence |
|---|---|---|
| 189 | rTT_degly-2rf_linKer-Fc-Hexamer | MKNLDCWVDNEEDIDVILKKSTILNLDINNDIISDISGFNSAVITYPDAQLVPGINGKAIHL VNNEASEVIVHKAMDIEYNDMFNNFTVSFWLRVPKVSASHLEQYGTNEYSIISSMKKHSLSI GSGWSVSLKGNNLIWTLKDSAGEVRQITFRDLPDKFNAYLANKWVFITITNDRLSSANLYIN GVLMGSAEITGLGAIREDNQITLKLDRCNNNQYVSIDKFRIFCKALNPKEIEKLYTSYLSI TFLRDFWGNPLRYDTEYYLIPVASSSKDVQLKQITDYMLTNAPSYTNGKLNIYYRRLYNGL KFIIKRYTPNNEIDSFVKSGDFIKLYVSYNNNEHIVGYPKDGNAFNNLDRILRVGYNAPGIP LYKKMEAVKLRDLKTYSVQLKLYDDKQASLGLVGTHNGQIGNDPNRDILIASNWYFNHLKDK ILGCDWYFVPTDEGWTNDgsaeaaakeaaakaEPKSCDKTHTCPKCPAPELLGGPSVFLFPP KPKDTLMISRTPEVTCVVVDVSHEDPEVKFNWYVDGVEVHNAKTKPREEQYNSTYRVVSVLT VCLQDWLNGKEYKCKVSNKALPAPIEKTISKAKGQPREPQVYTLPPSRDELTKNQVSLTCLV KGFYPSDIAVEWESNGQPENNYKTTPPVLDSDGSFFLYSKLTVDKSRWQQGNVFSCSVMHEA LHNHYTQKSLSLSPGKggsggPTLYNVSLVMSDTAGTCY |
| 190 | rTT_degly-1f_linker-Fc-Hexamer | MKNLDCWVDNEEDIDVILKKSTILNLDINNDIISDISGFNSAVITYPDAQLVPGINGKAIHL VNNEASEVIVHKAMDIEYNDMFNNFTVSFWLRVPKVSASHLEQYGTNEYSIISSMKKHSLSI GSGWSVSLKGNNLIWTLKDSAGEVRQITFRDLPDKFNAYLANKWVFITITNDRLSSANLYIN GVLMGSAEITGLGAIREDNQITLKLDRCNNNQYVSIDKFRIFCKALNPKEIEKLYTSYLSI TFLRDFWGNPLRYDTEYYLIPVASSSKDVQLKQITDYMLTNAPSYTNGKLNIYYRRLYNGL KFIIKRYTPNNEIDSFVKSGDFIKLYVSYNNNEHIVGYPKDGNAFNNLDRILRVGYNAPGIP LYKKMEAVKLRDLKTYSVQLKLYDDKQASLGLVGTHNGQIGNDPNRDILIASNWYFNHLKDK ILGCDWYFVPTDEGWTNDggggsasgEPKSCDKTHTCPKCPAPELLGGPSVFLFPPKPKDTL MISRTPEVTCVVVDVSHEDPEVKFNWYVDGVEVHNAKTKPREEQYNSTYRVVSVLTVCLQDW LNGKEYKCKVSNKALPAPIEKTISKAKGQPREPQVYTLPPSRDELTKNQVSLTCLVKGFYPS DIAVEWESNGQPENNYKTTPPVLDSDGSFFLYSKLTVDKSRWQQGNVFSCSVMHEALHNHYT QKSLSLSPGKggsggPTLYNVSLVMSDTAGTCY |
| 191 | rTT_degly-1rf_liner-Fc-Hexamer | MKNLDCWVDNEEDIDVILKKSTILNLDINNDIISDISGFNSAVITYPDAQLVPGINGKAIHL VNNEASEVIVHKAMDIEYNDMFNNFTVSFWLRVPKVSASHLEQYGTNEYSIISSMKKHSLSI GSGWSVSLKGNNLIWTLKDSAGEVRQITFRDLPDKFNAYLANKWVFITITNDRLSSANLYIN GVLMGSAEITGLGAIREDNQITLKLDRCNNNQYVSIDKFRIFCKALNPKEIEKLYTSYLSI TFLRDFWGNPLRYDTEYYLIPVASSSKDVQLKQITDYMLTNAPSYTNGKLNIYYRRLYNGL KFIIKRYTPNNEIDSFVKSGDFIKLYVSYNNNEHIVGYPKDGNAFNNLDRILRVGYNAPGIP LYKKMEAVKLRDLKTYSVQLKLYDDKQASLGLVGTHNGQIGNDPNRDILIASNWYFNHLKDK ILGCDWYFVPTDEGWTNDpapapasgEPKSCDKTHTCPKCPAPELLGGPSVFLFPPKPKDTL MISRTPEVTCVVVDVSHEDPEVKFNWYVDGVEVHNAKTKPREEQYNSTYRVVSVLTVCLQDW LNGKEYKCKVSNKALPAPIEKTISKAKGQPREPQVYTLPPSRDELTKNQVSLTCLVKGFYPS DIAVEWESNGQPENNYKTTPPVLDSDGSFFLYSKLTVDKSRWQQGNVFSCSVMHEALHNHYT QKSLSLSPGKggsggPTLYNVSLVMSDTAGTCY |
| | DIHYDROLIPOYL TRANSACETYLASE (e2p) | |
| 192 | CRM-e2p 1 | GADDVVDSSKSFVMENFSSYHGTKPGYVDSIQKGIQKPKSGTQGNYDDDWKEFYSTDNKYDA AGYSVDNENPLSGKAGGVVKVTYPGLTKVLALKVDNAETIKKELGLSLTEPLMEQVGTEEFI KRFGDGASRVVLSLPFAEGSSSVEYINNWEQAKALSVELEINFETGKRGQDAMYEYMAQAC AGNRVRRSVGSSLSCINLDWDVIRDKTKTKIESLKEHGPIKNKMSESPNKTVSEEKAKQYLE EFHQTALEHPELSELKTVTGTNPVFAGANYAAWAVNVAQVIDSETADNLEKTTAALSILPGI GSVMGIADGAVHHNTEEIVAQSIALSSLMVAQAIPLVGELVDIGFAAYNFVESIINLFQVVH NSYNRPAYSPGHKTQPFLHDGYAVSWNTVEDSIIRTGFQGESGHDIKITAENTPLPIAGVLL PTIPGKLDVNKSKTHISVNGRKIRMRCRAIDGDVTFCRPKSPVYVGNGVHANLHVAFHRSSS EKIHSNEISSDSIGVLGYQKTVDHTKVNSKLSLFFEIKggggsggggsGAAAKPATTEGEFP ETREKMSGIRRAIAKAMVHSKHTAPHVTLMDEADVTKLVAHRKKFKAIAAEKGIKLTFLPYV VKALVSALREYPVLNTAIDDETEEIIQKHYYNIGIAADTDRGLLVPVIKHADRKPIFALAQE INELAEKARDGKLTPGEMKGASCTITNIGSAGGQWFTPVINHPEVAILGIGRIAEKPIVRDG EIVAAPMLALSLSFDHRMIDGATAQKALNHIKRLLSDPELLLM |
| 193 | HID-e2p | SNMANTQMKSDKIIAHRGASGYLPEHTLESKALAFAQQADYLEQDLAMTKDGRLVVIHDHF LDGLTDVAKKFPHRHRKDGRYYVIDFTLKEIQSLEMTENFETKDGKQAQVYPNRFPLWKSHF RIHTFEDEIEFIQGLEKSTGKKVGIYPEIKAPWFHHQNGKDIAAETLKVLKKYGYDKKTDMV YLQTFDFNELKRIKTELLPQMGMDLKLVQLIAYTDWKETQEKDPKGYWVNYNYDWMFKPGAM AEVVKYADGVGPGWYMLVNKEESKPDNIVYTPLVKELAQYNVEVHPYTVRKDALPEFFTDVN QMYDALLNKSGATGVFTDFPDTGVEFLKGIKggggsggggsGAAAKPATTEGEFPETREKMS GIRRAIAKAMVHSKHTAPHVTLMDEADVTKLVAHRKKFKAIAAEKGIKLTFLPYVVKALVSA LREYPVLNTAIDDETEEIIQKHYYNIGIAADTDRGLLVPVIKHADRKPIFALAQEINELAEK ARDGKLTPGEMKGASCTITNIGSAGGQWFTPVINHPEVAILGIGRIAEKPIVRDGEIVAAPM LALSLSFDHRMIDGATAQKALNHIKRLLSDPELLLM |
| 194 | CRM-e2p 2 | GADDVVDSSKSFVMENFSSYHGTKPGYVDSIQKGIQKPKSGTQGNYDDDWKEFYSTDNKYDA AGYSVDNENPLSGKAGGVVKVTYPGLTKVLALKVDNAETIKKELGLSLTEPLMEQVGTEEFI KRFGDGASRVVLSLPFAEGSSSVEYINNWEQAKALSVELEINFETGKRGQDAMYEYMAQAC AGNRVRRSVGSSLSCINLDWDVIRDKTKTKIESLKEHGPIKNKMSESPNKTVSEEKAKQYLE EFHQTALEHPELSELKTVTGTNPVFAGANYAAWAVNVAQVIDSETADNLEKTTAALSILPGI GSVMGIADGAVHHNTEEIVAQSIALSSLMVAQAIPLVGELVDIGFAAYNFVESIINLFQVVH NSYNRPAYSPGHKTQPFLHDGYAVSWNTVEDSIIRTGFQGESGHDIKITAENTPLPIAGVLL PTIPGKLDVNKSKTHISVNGRKIRMRCRAIDGDVTFCRPKSPVYVGNGVHANLHVAFHRSSS |

TABLE 1-continued

Exemplary sequences of fusion proteins containing a protein nanoparticle subunit fused to a heterologous carrier protein and optionally a heterologous T-cell helper epitope.

| SEQ

TABLE 1-continued

Exemplary sequences of fusion proteins containing a protein nanoparticle subunit fused to a heterologous carrier protein and optionally a heterologous T-cell helper epitope.

| SEQ ID NO | Name | Sequence |
|---|---|---|
| 200 | rTT_degly-1f-E2p | MKNLDCWVDNEEDIDVILKKSTILNLDINNDIISDISGFNSAVITYPDAQLVPGINGKAIHL<br>VNNEASEVIVHKAMDIEYNDMFNNFTVSFWLRVPKVSASHLEQYGTNEYSIISSMKKHSLSI<br>GSGWSVSLKGNNLIWTLKDSAGEVRQITFRDLPDKFNAYLANKWVFITITNDRLSSANLYIN<br>GVLMGSAEITGLGAIREDNQITLKLDRCNNNNQYVSIDKFRIFCKALNPKEIEKLYTSYLSI<br>TFLRDFWGNPLRYDTEYYLIPVASSSKDVQLKQITDYMYLTNAPSYTNGKLNIYYRRLYNGL<br>KFIIKRYTPNNEIDSFVKSGDFIKLYVSYNNNEHIVGYPKDGNAFNNLDRILRVGYNAPGIP<br>LYKKMEAVKLRDLKTYSVQLKLYDDKQASLGLVGTHNGQIGNDPNRDILIASNWYFNHLKDK<br>ILGCDWYFVPTDEGWTNDggggsasgAAAKPATTEGEFPETREKMSGIRRAIAKAMVHSKHT<br>APHVTLMDEADVTKLVAHRKKFKAIAAEKGIKLTFLPYVVKALVSALREYPVLNTAIDDETE<br>EIIQKHYYNIGIAADTDRGLLVPVIKHADRKPIFALAQEINELAEKARDGKLTPGEMKGASC<br>TITNIGSAGGQWFTPVINHPEVAILGIGRIAEKPIVRDGEIVAAPMLALSLSFDHRMIDGAT<br>AQKALNHIKRLLSDPELLLM |
| 201 | rTT_degly-r8-E2p | MKNLDCWVDNEEDIDVILKKSTILNLDINNDIISDISGFNSAVITYPDAQLVPGINGKAIHL<br>VNNEASEVIVHKAMDIEYNDMFNNFTVSFWLRVPKVSASHLEQYGTNEYSIISSMKKHSLSI<br>GSGWSVSLKGNNLIWTLKDSAGEVRQITFRDLPDKFNAYLANKWVFITITNDRLSSANLYIN<br>GVLMGSAEITGLGAIREDNQITLKLDRCNNNNQYVSIDKFRIFCKALNPKEIEKLYTSYLSI<br>TFLRDFWGNPLRYDTEYYLIPVASSSKDVQLKQITDYMYLTNAPSYTNGKLNIYYRRLYNGL<br>KFIIKRYTPNNEIDSFVKSGDFIKLYVSYNNNEHIVGYPKDGNAFNNLDRILRVGYNAPGIP<br>LYKKMEAVKLRDLKTYSVQLKLYDDKQASLGLVGTHNGQIGNDPNRDILIASNWYFNHLKDK<br>ILGCDWYFVPTDEGWTNDggaeaaakeaaakeaaakeaaakaleaeaaakeaaakeaaakea<br>aakasgAAAKPATTEGEFPETREKMSGIRRAIAKAMVHSKHTAPHVTLMDEADVTKLVAHRK<br>KFKAIAAEKGIKLTFLPYVVKALVSALREYPVLNTAIDDETEEIIQKHYYNIGIAADTDRGL<br>LVPVIKHADRKPIFALAQEINELAEKARDGKLTPGEMKGASCTITNIGSAGGQWFTPVINHP<br>EVAILGIGRIAEKPIVRDGEIVAAPMLALSLSFDHRMIDGATAQKALNHIKRLLSDPELLLM |
| 202 | rTT_degly-r12-E2p | MKNLDCWVDNEEDIDVILKKSTILNLDINNDIISDISGFNSAVITYPDAQLVPGINGKAIHL<br>VNNEASEVIVHKAMDIEYNDMFNNFTVSFWLRVPKVSASHLEQYGTNEYSIISSMKKHSLSI<br>GSGWSVSLKGNNLIWTLKDSAGEVRQITFRDLPDKFNAYLANKWVFITITNDRLSSANLYIN<br>GVLMGSAEITGLGAIREDNQITLKLDRCNNNNQYVSIDKFRIFCKALNPKEIEKLYTSYLSI<br>TFLRDFWGNPLRYDTEYYLIPVASSSKDVQLKQITDYMYLTNAPSYTNGKLNIYYRRLYNGL<br>KFIIKRYTPNNEIDSFVKSGDFIKLYVSYNNNEHIVGYPKDGNAFNNLDRILRVGYNAPGIP<br>LYKKMEAVKLRDLKTYSVQLKLYDDKQASLGLVGTHNGQIGNDPNRDILIASNWYFNHLKDK<br>ILGCDWYFVPTDEGWTNDgsapapapapapapapapapapapapasgAAAKPATTEGEFPET<br>REKMSGIRRAIAKAMVHSKHTAPHVTLMDEADVTKLVAHRKKFKAIAAEKGIKLTFLPYVVK<br>ALVSALREYPVLNTAIDDETEEIIQKHYYNIGIAADTDRGLLVPVIKHADRKPIFALAQEIN<br>ELAEKARDGKLTPGEMKGASCTITNIGSAGGQWFTPVINHPEVAILGIGRIAEKPIVRDGEI<br>VAAPMLALSLSFDHRMIDGATAQKALNHIKRLLSDPELLLM |
| 203 | rTT_degly-r3-E2p | MKNLDCWVDNEEDIDVILKKSTILNLDINNDIISDISGFNSAVITYPDAQLVPGINGKAIHL<br>VNNEASEVIVHKAMDIEYNDMFNNFTVSFWLRVPKVSASHLEQYGTNEYSIISSMKKHSLSI<br>GSGWSVSLKGNNLIWTLKDSAGEVRQITFRDLPDKFNAYLANKWVFITITNDRLSSANLYIN<br>GVLMGSAEITGLGAIREDNQITLKLDRCNNNNQYVSIDKFRIFCKALNPKEIEKLYTSYLSI<br>TFLRDFWGNPLRYDTEYYLIPVASSSKDVQLKQITDYMYLTNAPSYTNGKLNIYYRRLYNGL<br>KFIIKRYTPNNEIDSFVKSGDFIKLYVSYNNNEHIVGYPKDGNAFNNLDRILRVGYNAPGIP<br>LYKKMEAVKLRDLKTYSVQLKLYDDKQASLGLVGTHNGQIGNDPNRDILIASNWYFNHLKDK<br>ILGCDWYFVPTDEGWTNDgaeaaakeaaakeaaakasgAAAKPATTEGEFPETREKMSGIRR<br>AIAKAMVHSKHTAPHVTLMDEADVTKLVAHRKKFKAIAAEKGIKLTFLPYVVKALVSALREY<br>PVLNTAIDDETEEIIQKHYYNIGIAADTDRGLLVPVIKHADRKPIFALAQEINELAEKARDG<br>KLTPGEMKGASCTITNIGSAGGQWFTPVINHPEVAILGIGRIAEKPIVRDGEIVAAPMLALS<br>LSFDHRMIDGATAQKALNHIKRLLSDPELLLM |
| 204 | rTT_degly-2rf-E2p | MKNLDCWVDNEEDIDVILKKSTILNLDINNDIISDISGFNSAVITYPDAQLVPGINGKAIHL<br>VNNEASEVIVHKAMDIEYNDMFNNFTVSFWLRVPKVSASHLEQYGTNEYSIISSMKKHSLSI<br>GSGWSVSLKGNNLIWTLKDSAGEVRQITFRDLPDKFNAYLANKWVFITITNDRLSSANLYIN<br>GVLMGSAEITGLGAIREDNQITLKLDRCNNNNQYVSIDKFRIFCKALNPKEIEKLYTSYLSI<br>TFLRDFWGNPLRYDTEYYLIPVASSSKDVQLKQITDYMYLTNAPSYTNGKLNIYYRRLYNGL<br>KFIIKRYTPNNEIDSFVKSGDFIKLYVSYNNNEHIVGYPKDGNAFNNLDRILRVGYNAPGIP<br>LYKKMEAVKLRDLKTYSVQLKLYDDKQASLGLVGTHNGQIGNDPNRDILIASNWYFNHLKDK<br>ILGCDWYFVPTDEGWTNDgsaeaaakeaaakasgAAAKPATTEGEFPETREKMSGIRRAIAK<br>AMVHSKHTAPHVTLMDEADVTKLVAHRKKFKAIAAEKGIKLTFLPYVVKALVSALREYPVLN<br>TAIDDETEEIIQKHYYNIGIAADTDRGLLVPVIKHADRKPIFALAQEINELAEKARDGKLTP<br>GEMKGASCTITNIGSAGGQWFTPVINHPEVAILGIGRIAEKPIVRDGEIVAAPMLALSLSFD<br>HRMIDGATAQKALNHIKRLLSDPELLLM |
| | | Glutamate Synthase, Chain A (1f52) |
| 205 | 6H-3C-HiD-1f52 | Snmantqmksdkiiiahrgasgylpehtleskalafaqqadyleqdlamtkdgrlvvihdhf<br>ldgltdvakkfphrhrkdgryyvidftlkeigslemtenfetkdgkqaqvypnrfplwkshf<br>rihtfedeiefigglekstgkkvgiypeikapwfhhqngkdiaaetlkylkkygydkktdmv<br>ylqtfdfnelkriktellpqmgmdlklvqliaytdwketqekdpkgywynynydwmfkpgam<br>aevykyadgvgpgwymlynkeeskpdnivytplykelagynvevhpytyrkdalpefftdvn<br>qmydallnksgatgvftdfpdtgveflkgikSAEHVLTMLNEHEVKFVDLRFTDTKGKEQHV<br>TIPAHQVNAEFFEEGKMFDGSSIGGWKGINESDMVLMPDASTAVIDPFFADSTLIIRCDILE |

TABLE 1-continued

Exemplary sequences of fusion proteins containing a protein nanoparticle subunit fused to a heterologous carrier protein and optionally a heterologous T-cell helper epitope.

| SEQ ID NO | Name | Sequence |
|---|---|---|
| | | PGTLQGYDRDPRSIAKRAEDYLRATGIADTVLFGPEPEFFLFDDIRFGASISGSHVAIDDIE<br>GAWNSSTKYEGGNKGHRPGVKGGYFPVPPVDSAQDIRSEMCLVMEQMGLVVEAHHHEVATAG<br>QNEVATRFNTMTKKADEIQIYKYVVHNVAHRFGKTATFMPKPMFGDNGSGMHCHMSLAKNGT<br>NLFSGDKYAGLSEQALYYIGGVIKHAKAINALANPTTNSYKRLVPGYEAPVMLAYSARNRSA<br>SIRIPVVASPKARRIEVRFPDPAANPYLCFAALLMAGLDGIKNKIHPGEPMDKNLYDLPPEE<br>AKEIPQVAGSLEEALNALDLDREFLKAGGVFTDEAIDAYIALRREEDDRVRMTPHPVEFELY<br>YSV |
| 206 | 6H-3C-<br>rTT-1f52 | MKNLDCWVDNEEDIDVILKKSTILNLDINNDIISDISGFNSSVITYPDAQLVPGINGKAIHL<br>VNNESSEVIVHKAMDIEYNDMFNNFTVSFWLRVPKVSASHLEQYGTNEYSIISSMKKHSLSI<br>GSGWSVSLKGNNLIWTLKDSAGEVRQITFRDLPDKFNAYLANKWVFITITNDRLSSANLYIN<br>GVLMGSAEITGLGAIREDNNITLKLDRCNNNNQYVSIDKFRIFCKALNPKEIEKLYTSYLSI<br>TFLRDFWGNPLRYDTEYYLIPVASSSKDVQLKNITDYMYLTNAPSYTNGKLNIYYRRLYNGL<br>KFIIKRYTPNNEIDSFVKSGDFIKLYVSYNNNEHIVGYPKDGNAFNNLDRILRVGYNAPGIP<br>LYKKMEAVKLRDLKTYSVQLKLYDDKNASLGLVGTHNGQIGNDPNRDILIASNWYFNHLKDK<br>ILGCDWYFVPTDEGWTNDSAEHVLTMLNEHEVKFVDLRFTDTKGKEQHVTIPAHQVNAEFFE<br>EGKMFDGSSIGGWKGINESDMVLMPDASTAVIDPFFADSTLIIRCDILEPGTLQGYDRDPRS<br>IAKRAEDYLRATGIADTVLFGPEPEFFLFDDIRFGASISGSHVAIDDIEGAWNSSTKYEGGN<br>KGHRPGVKGGYFPVPPVDSAQDIRSEMCLVMEQMGLVVEAHHHEVATAGQNEVATRFNTMTK<br>KADEIQIYKYVVHNVAHRFGKTATFMPKPMFGDNGSGMHCHMSLAKNGTNLFSGDKYAGLSE<br>QALYYIGGVIKHAKAINALANPTTNSYKRLVPGYEAPVMLAYSARNRSASIRIPVVASPKAR<br>RIEVRFPDPAANPYLCFAALLMAGLDGIKNKIHPGEPMDKNLYDLPPEEAKEIPQVAGSLEE<br>ALNALDLDREFLKAGGVFTDEAIDAYIALRREEDDRVRMTPHPVEFELYYSV |
| 207 | 6H-3C-<br>rTT- ln4-<br>1f52 | MKNLDCWVDNEEDIDVILKKSTILNLDINNDIISDISGFNSSVITYPDAQLVPGINGKAIHL<br>VNNESSEVIVHKAMDIEYNDMFNNFTVSFWLRVPKVSASHLEQYGTNEYSIISSMKKHSLSI<br>GSGWSVSLKGNNLIWTLKDSAGEVRQITFRDLPDKFNAYLANKWVFITITNDRLSSANLYIN<br>GVLMGSAEITGLGAIREDNNITLKLDRCNNNNQYVSIDKFRIFCKALNPKEIEKLYTSYLSI<br>TFLRDFWGNPLRYDTEYYLIPVASSSKDVQLKNITDYMYLTNAPSYTNGKLNIYYRRLYNGL<br>KFIIKRYTPNNEIDSFVKSGDFIKLYVSYNNNEHIVGYPKDGNAFNNLDRILRVGYNAPGIP<br>LYKKMEAVKLRDLKTYSVQLKLYDDKNASLGLVGTHNGQIGNDPNRDILIASNWYFNHLKDK<br>ILGCDWYFVPTDEGWTNDgggsSAEHVLTMLNEHEVKFVDLRFTDTKGKEQHVTIPAHQVNA<br>EFFEEGKMFDGSSIGGWKGINESDMVLMPDASTAVIDPFFADSTLIIRCDILEPGTLQGYDR<br>DPRSIAKRAEDYLRATGIADTVLFGPEPEFFLFDDIRFGASISGSHVAIDDIEGAWNSSTKY<br>EGGNKGHRPGVKGGYFPVPPVDSAQDIRSEMCLVMEQMGLVVEAHHHEVATAGQNEVATRFN<br>TMTKKADEIQIYKYVVHNVAHRFGKTATFMPKPMFGDNGSGMHCHMSLAKNGTNLFSGDKYA<br>GLSEQALYYIGGVIKHAKAINALANPTTNSYKRLVPGYEAPVMLAYSARNRSASIRIPVVAS<br>PKARRIEVRFPDPAANPYLCFAALLMAGLDGIKNKIHPGEPMDKNLYDLPPEEAKEIPQVAG<br>SLEEALNALDLDREFLKAGGVFTDEAIDAYIALRREEDDRVRMTPHPVEFELYYSV |
| 208 | 6H-3C-<br>CRM_degly-<br>1f52 | GADDVVDSSKSFVMENFASYHGTKPGYVDSIQKGIQKPKSGTQGNYDDDWKEFYSTDNKYDA<br>AGYSVDNENPLSGKAGGVVKVTYPGLTKVLALKVDNAETIKKELGLSLTEPLMEQVGTEEFI<br>KRFGDGASRVVLSLPFAEGSSSVEYINNWEQAKALSVELEINFETRGKRGQDAMYEYMAQAC<br>AGNRVRRSVGSSLSCINLDWDVIRDKTKTKIESLKEHGPIKNKMSESPNKAVSEEKAKQYLE<br>EFHQTALEHPELSELKTVTGTNPVFAGANYAAWAVNVAQVIDSETADNLEKTTAALSILPGI<br>GSVMGIADGAVHHNTEEIVAQSIALSSLMVAQAIPLVGELVDIGFAAYNFVESIINLFQVVH<br>NSYNRPAYSPGHKTQPFLHDGYAVSWNTVEDSIIRTGFQGESGHDIKITAENTPLPIAGVLL<br>PTIPGKLDVNKAKTHISVNGRKIRMRCRAIDGDVTFCRPKSPVYVGNGVHANLHVAFHRSSS<br>EKIHSNEISSDSIGVLGYQKTVDHTKVNSKLSLFFEIKSSAEHVLTMLNEHEVKFVDLRFTD<br>TKGKEQHVTIPAHQVNAEFFEEGKMFDGSSIGGWKGINESDMVLMPDASTAVIDPFFADSTL<br>IIRCDILEPGTLQGYDRDPRSIAKRAEDYLRATGIADTVLFGPEPEFFLFDDIRFGASISGS<br>HVAIDDIEGAWNSSTKYEGGNKGHRPGVKGGYFPVPPVDSAQDIRSEMCLVMEQMGLVVEAH<br>HHEVATAGQNEVATRFNTMTKKADEIQIYKYVVHNVAHRFGKTATFMPKPMFGDNGSGMHCH<br>MSLAKNGTNLFSGDKYAGLSEQALYYIGGVIKHAKAINALANPTTNSYKRLVPGYEAPVMLA<br>YSARNRSASIRIPVVASPKARRIEVRFPDPAANPYLCFAALLMAGLDGIKNKIHPGEPMDKN<br>LYDLPPEEAKEIPQVAGSLEEALNALDLDREFLKAGGVFTDEAIDAYIALRREEDDRVRMTP<br>HPVEFELYYSV |
| 209 | 6H-3C-<br>CRM_degly-<br>ln4-1f52 | GADDVVDSSKSFVMENFASYHGTKPGYVDSIQKGIQKPKSGTQGNYDDDWKEFYSTDNKYDA<br>AGYSVDNENPLSGKAGGVVKVTYPGLTKVLALKVDNAETIKKELGLSLTEPLMEQVGTEEFI<br>KRFGDGASRVVLSLPFAEGSSSVEYINNWEQAKALSVELEINFETRGKRGQDAMYEYMAQAC<br>AGNRVRRSVGSSLSCINLDWDVIRDKTKTKIESLKEHGPIKNKMSESPNKAVSEEKAKQYLE<br>EFHQTALEHPELSELKTVTGTNPVFAGANYAAWAVNVAQVIDSETADNLEKTTAALSILPGI<br>GSVMGIADGAVHHNTEEIVAQSIALSSLMVAQAIPLVGELVDIGFAAYNFVESIINLFQVVH<br>NSYNRPAYSPGHKTQPFLHDGYAVSWNTVEDSIIRTGFQGESGHDIKITAENTPLPIAGVLL<br>PTIPGKLDVNKAKTHISVNGRKIRMRCRAIDGDVTFCRPKSPVYVGNGVHANLHVAFHRSSS<br>EKIHSNEISSDSIGVLGYQKTVDHTKVNSKLSLFFEIKSgggsSAEHVLTMLNEHEVKFVDL<br>RFTDTKGKEQHVTIPAHQVNAEFFEEGKMFDGSSIGGWKGINESDMVLMPDASTAVIDPFFA<br>DSTLIIRCDILEPGTLQGYDRDPRSIAKRAEDYLRATGIADTVLFGPEPEFFLFDDIRFGAS<br>ISGSHVAIDDIEGAWNSSTKYEGGNKGHRPGVKGGYFPVPPVDSAQDIRSEMCLVMEQMGLV |

TABLE 1-continued

Exemplary sequences of fusion proteins containing a protein nanoparticle subunit fused to a heterologous carrier protein and optionally a heterologous T-cell helper epitope.

| SEQ ID NO | Name | Sequence |
|---|---|---|
| | | *VEAHHHEVATAGQNEVATRFNTMTKKADEIQIYKYVVHNVAHRFGKTATFMPKPMFGDNGSG MHCHMSLAKNGTNLFSGDKYAGLSEQALYYIGGVIKHAKAINALANPTTNSYKRLVPGYEAP VMLAYSARNRSASIRIPVVASPKARRIEVRFPDPAANPYLCFAALLMAGLDGIKNKIHPGEP MDKNLYDLPPEEAKEIPQVAGSLEEALNALDLDREFLKAGGVFTDEAIDAYIALRREEDDRV RMTPHPVEFELYYSV* |
| 210 | 6H-3C-CRM_degly-ln8-1f52 | GADDVVDSSKSFVMENFASYHGTKPGYVDSIQKGIQKPKSGTQGNYDDDWKEFYSTDNKYDA AGYSVDNENPLSGKAGGVVKVTYPGLTKVLALKVDNAETIKKELGLSLTEPLMEQVGTEEFI KRFGDGASRVVLSLPFAEGSSSVEYINNWEQAKALSVELEINFETRGKRGQDAMYEYMAQAC AGNRVRRSVGSSLSCINLDWDVIRDKTKTKIESLKEHGPIKNKMSESPNKAVSEEKAKQYLE EFHQTALEHPELSELKTVTGTNPVFAGANYAAWAVNVAQVIDSETADNLEKTTAALSILPGI GSVMGIADGAVHHNTEEIVAQSIALSSLMVAQAIPLVGELVDIGFAAYNFVESIINLFQVVH NSYNRPAYSPGHKTQPFLHDGYAVSWNTVEDSIIRTGFQGESGHDIKITAENTPLPIAGVLL PTIPGKLDVNKAKTHISVNGRKIRMRCRAIDGDVTFCRPKSPVYVGNGVHANLHVAFHRSSS EKIHSNEISSDSIGVLGYQKTVDHTKVNSKLSLFFEIKSgggsgggsSAEHVTMLNEHEVK *FVDLRFTDTKGKEQHVTIPAHQVNAEFFEEGKMFDGSSIGGWKGINESDMVLMPDASTAVID PFFADSTLIIRCDILEPGTLQGYDRDPRSIAKRAEDYLRATGIADTVLFGPEPEFFLFDDIR FGASISGSHVAIDDIEGAWNSSTKYEGGNKGHRPGVKGGYFPVPPVDSAQDIRSEMCLVMEQ MGLVVEAHHHEVATAGQNEVATRFNTMTKKADEIQIYKYVVHNVAHRFGKTATFMPKPMFGD NGSGMHCHMSLAKNGTNLFSGDKYAGLSEQALYYIGGVIKHAKAINALANPTTNSYKRLVPG YEAPVMLAYSARNRSASIRIPVVASPKARRIEVRFPDPAANPYLCFAALLMAGLDGIKNKIH PGEPMDKNLYDLPPEEAKEIPQVAGSLEEALNALDLDREFLKAGGVFTDEAIDAYIALRREE DDRVRMTPHPVEFELYYSV* |
| | HIV capsid oligerization domain (HIV) | |
| 211 | HIV-CA-3P0A-rTT | *PIVQNLQGQMVHQAISCLCLNAWVKVVEEKAFSPEVIPMFSALSEGATPQDLNTMLNTVGGH QAAMQMLKETINEEAAEWDRLHPVHAGPIAPGQMREPRGSDIAGTTSTLQEQIGWMTHNPPI PVGEIYKRWIILGLNKIVRMYSPTSILDIRQGPKEPFRDYVDRFYKTLRAEQASQEVKNAAT ETLLVQNANPDCKTILKALGPGATLEEMMTACQGVGGPGHKARVKNLDCWVDNEEDIDVILK KSTILNLDINNDIISDISGFNSSVITYPDAQLVPGINGKAIHLVNNESSEVIVHKAMDIEYN DMFNNFTVSFWLRVPKVSASHLEQYGTNEYSIISSMKKHSLSIGSGWSVSLKGNNLIWTLKD SAGEVRQITFRDLPDKFNAYLANKWVFITITNDRLSSANLYINGVLMGSAEITGLGAIREDN NITLKLDRCNNNNQYVSIDKFRIFCKALNPKEIEKLYTSYLSITFLRDFWGNPLRYDTEYYL IPVASSSKDVQLKNITDYMYLTNAPSYTNGKLNIYYRRLYNGLKFIIKRYTPNNEIDSFVKS GDFIKLYVSYNNNEHIVGYPKDGNAFNNLDRILRVGYNAPGIPLYKKMEAVKLRDLKTYSVQ LKLYDDKNASLGLVGTHNGQIGNDPNRDILIASNWYFNHLKDKILGCDWYFVPTDEGWTND* |
| 212 | HIV-CA-3P0A-rTT-858 | *PIVQNLQGQMVHQAISCLCLNAWVKVVEEKAFSPEVIPMFSALSEGATPQDLNTMLNTVGGH QAAMQMLKETINEEAAEWDRLHPVHAGPIAPGQMREPRGSDIAGTTSTLQEQIGWMTHNPPI PVGEIYKRWIILGLNKIVRMYSPTSILDIRQGPKEPFRDYVDRFYKTLRAEQASQEVKNAAT ETLLVQNANPDCKTILKALGPGATLEEMMTACQGVGGPGHKARVpipfsysKNLDCWVDNEE DIDVILKKSTILNLDINNDIISDISGFNSSVITYPDAQLVPGINGKAIHLVNNESSEVIVHK AMDIEYNDMFNNFTVSFWLRVPKVSASHLEQYGTNEYSIISSMKKHSLSIGSGWSVSLKGNN LIWTLKDSAGEVRQITFRDLPDKFNAYLANKWVFITITNDRLSSANLYINGVLMGSAEITGL GAIREDNNITLKLDRCNNNNQYVSIDKFRIFCKALNPKEIEKLYTSYLSITFLRDFWGNPLR YDTEYYLIPVASSSKDVQLKNITDYMYLTNAPSYTNGKLNIYYRRLYNGLKFIIKRYTPNNE IDSFVKSGDFIKLYVSYNNNEHIVGYPKDGNAFNNLDRILRVGYNAPGIPLYKKMEAVKLRD LKTYSVQLKLYDDKNASLGLVGTHNGQIGNDPNRDILIASNWYFNHLKDKILGCDWYFVPTD EGWTND* |
| 213 | HIV-CA-3P0A-rTT-836 | *PIVQNLQGQMVHQAISCLCLNAWVKVVEEKAFSPEVIPMFSALSEGATPQDLNTMLNTVGGH QAAMQMLKETINEEAAEWDRLHPVHAGPIAPGQMREPRGSDIAGTTSTLQEQIGWMTHNPPI PVGEIYKRWIILGLNKIVRMYSPTSILDIRQGPKEPFRDYVDRFYKTLRAEQASQEVKNAAT ETLLVQNANPDCKTILKALGPGATLEEMMTACQGVGGPGHKARVskfigitelkkleskink vfsTpipfsysKNLDCWVDNEEDIDVILKKSTILNLDINNDIISDISGFNSSVITYPDAQLV PGINGKAIHLVNNESSEVIVHKAMDIEYNDMFNNFTVSFWLRVPKVSASHLEQYGTNEYSII SSMKKHSLSIGSGWSVSLKGNNLIWTLKDSAGEVRQITFRDLPDKFNAYLANKWVFITITND RLSSANLYINGVLMGSAEITGLGAIREDNNITLKLDRCNNNNQYVSIDKFRIFCKALNPKEI EKLYTSYLSITFLRDFWGNPLRYDTEYYLIPVASSSKDVQLKNITDYMYLTNAPSYTNGKLN IYYRRLYNGLKFIIKRYTPNNEIDSFVKSGDFIKLYVSYNNNEHIVGYPKDGNAFNNLDRIL RVGYNAPGIPLYKKMEAVKLRDLKTYSVQLKLYDDKNASLGLVGTHNGQIGNDPNRDILIAS NWYFNHLKDKILGCDWYFVPTDEGWTND* |
| 214 | HIV-CA-3P0A-rTT-217-839 | *PIVQNLQGQMVHQAISCLCLNAWVKVVEEKAFSPEVIPMFSALSEGATPQDLNTMLNTVGGH QAAMQMLKETINEEAAEWDRLHPVHAGPIAPGQMREPRGSDIAGTTSTLQEQIGWMTHNPPI PVGEIYKRWIILGLNKIVRMYSPTSILDIRQGPKEPFRDYVDRFYKTLRAEQASQEVKNAAT ETLLVQNANPDCKTILKALGPGATLEEMMTAigitelkkleskinkvfsTpipfsysKNLDC WVDNEEDIDVILKKSTILNLDINNDIISDISGFNSSVITYPDAQLVPGINGKAIHLVNNESS EVIVHKAMDIEYNDMFNNFTVSFWLRVPKVSASHLEQYGTNEYSIISSMKKHSLSIGSGWSV SLKGNNLIWTLKDSAGEVRQITFRDLPDKFNAYLANKWVFITITNDRLSSANLYINGVLMGS AEITGLGAIREDNNITLKLDRCNNNNQYVSIDKFRIFCKALNPKEIEKLYTSYLSITFLRDF WGNPLRYDTEYYLIPVASSSKDVQLKNITDYMYLTNAPSYTNGKLNIYYRRLYNGLKFIIKR YTPNNEIDSFVKSGDFIKLYVSYNNNEHIVGYPKDGNAFNNLDRILRVGYNAPGIPLYKKME* |

TABLE 1-continued

Exemplary sequences of fusion proteins containing a protein nanoparticle subunit fused to a heterologous carrier protein and optionally a heterologous T-cell helper epitope.

| SEQ ID NO | Name | Sequence |
|---|---|---|
| | | AVKLRDLKTYSVQLKLYDDKNASLGLVGTHNGQIGNDPNRDILIASNWYFNHLKDKILGCDW<br>YFVPTDEGWTND |
| 215 | HIV-CA-<br>3P0A-rTT-<br>217-840 | *PIVQNLQGQMVHQAISCLCLNAWVKVVEEKAFSPEVIPMFSALSEGATPQDLNTMLNTVGGH*<br>*QAAMQMLKETINEEAAEWDRLHPVHAGPIAPGQMREPRGSDIAGTTSTLQEQIGWMTHNPPI*<br>*PVGEIYKRWIILGLNKIVRMYSPTSILDIRQGPKEPFRDYVDRFYKTLRAEQASQEVKNAAT*<br>*ETLLVQNANPDCKTILKALGPGATLEEMMTA*gitelkkleskinkvfsTpipfsysKNLDCW<br>VDNEEDIDVILKKSTILNLDINNDIISDISGFNSSVITYPDAQLVPGINGKAIHLVNNESSE<br>VIVHKAMDIEYNDMFNNFTVSFWLRVPKVSASHLEQYGTNEYSIISSMKKHSLSIGSGWSVS<br>LKGNNLIWTLKDSAGEVRQITFRDLPDKFNAYLANKWVFITITNDRLSSANLYINGVLMGSA<br>EITGLGAIREDNNITLKLDRCNNNNQYVSIDKFRIFCKALNPKEIEKLYTSYLSITFLRDFW<br>GNPLRYDTEYYLIPVASSSKDVQLKNITDYMYLTNAPSYTNGKLNIYYRRLYNGLKFIIKRY<br>TPNNEIDSFVKSGDFIKLYVSYNNNEHIVGYPKDGNAFNNLDRILRVGYNAPGIPLYKKMEA<br>VKLRDLKTYSVQLKLYDDKNASLGLVGTHNGQIGNDPNRDILIASNWYFNHLKDKILGCDWY<br>FVPTDEGWTND |
| 216 | HIV-CA-<br>3P0A-rTT-<br>217-841 | *PIVQNLQGQMVHQAISCLCLNAWVKVVEEKAFSPEVIPMFSALSEGATPQDLNTMLNTVGGH*<br>*QAAMQMLKETINEEAAEWDRLHPVHAGPIAPGQMREPRGSDIAGTTSTLQEQIGWMTHNPPI*<br>*PVGEIYKRWIILGLNKIVRMYSPTSILDIRQGPKEPFRDYVDRFYKTLRAEQASQEVKNAAT*<br>*ETLLVQNANPDCKTILKALGPGATLEEMMTA*itelkkleskinkvfsTpipfsysKNLDCWV<br>DNEEDIDVILKKSTILNLDINNDIISDISGFNSSVITYPDAQLVPGINGKAIHLVNNESSEV<br>IVHKAMDIEYNDMFNNFTVSFWLRVPKVSASHLEQYGTNEYSIISSMKKHSLSIGSGWSVSL<br>KGNNLIWTLKDSAGEVRQITFRDLPDKFNAYLANKWVFITITNDRLSSANLYINGVLMGSAE<br>ITGLGAIREDNNITLKLDRCNNNNQYVSIDKFRIFCKALNPKEIEKLYTSYLSITFLRDFWG<br>NPLRYDTEYYLIPVASSSKDVQLKNITDYMYLTNAPSYTNGKLNIYYRRLYNGLKFIIKRYT<br>PNNEIDSFVKSGDFIKLYVSYNNNEHIVGYPKDGNAFNNLDRILRVGYNAPGIPLYKKMEAV<br>KLRDLKTYSVQLKLYDDKNASLGLVGTHNGQIGNDPNRDILIASNWYFNHLKDKILGCDWYF<br>VPTDEGWTND |
| 217 | HIV-CA-<br>3P0A-rTT-<br>217-842 | *PIVQNLQGQMVHQAISCLCLNAWVKVVEEKAFSPEVIPMFSALSEGATPQDLNTMLNTVGGH*<br>*QAAMQMLKETINEEAAEWDRLHPVHAGPIAPGQMREPRGSDIAGTTSTLQEQIGWMTHNPPI*<br>*PVGEIYKRWIILGLNKIVRMYSPTSILDIRQGPKEPFRDYVDRFYKTLRAEQASQEVKNAAT*<br>*ETLLVQNANPDCKTILKALGPGATLEEMMTA*telkkleskinkvfsTpipfsysKNLDCWVD<br>NEEDIDVILKKSTILNLDINNDIISDISGFNSSVITYPDAQLVPGINGKAIHLVNNESSEVI<br>VHKAMDIEYNDMFNNFTVSFWLRVPKVSASHLEQYGTNEYSIISSMKKHSLSIGSGWSVSLK<br>GNNLIWTLKDSAGEVRQITFRDLPDKFNAYLANKWVFITITNDRLSSANLYINGVLMGSAEI<br>TGLGAIREDNNITLKLDRCNNNNQYVSIDKFRIFCKALNPKEIEKLYTSYLSITFLRDFWGN<br>PLRYDTEYYLIPVASSSKDVQLKNITDYMYLTNAPSYTNGKLNIYYRRLYNGLKFIIKRYTP<br>NNEIDSFVKSGDFIKLYVSYNNNEHIVGYPKDGNAFNNLDRILRVGYNAPGIPLYKKMEAVK<br>LRDLKTYSVQLKLYDDKNASLGLVGTHNGQIGNDPNRDILIASNWYFNHLKDKILGCDWYFV<br>PTDEGWTND |
| 218 | HIV-CA-<br>3P0A-rTT-<br>217-843 | *PIVQNLQGQMVHQAISCLCLNAWVKVVEEKAFSPEVIPMFSALSEGATPQDLNTMLNTVGGH*<br>*QAAMQMLKETINEEAAEWDRLHPVHAGPIAPGQMREPRGSDIAGTTSTLQEQIGWMTHNPPI*<br>*PVGEIYKRWIILGLNKIVRMYSPTSILDIRQGPKEPFRDYVDRFYKTLRAEQASQEVKNAAT*<br>*ETLLVQNANPDCKTILKALGPGATLEEMMTA*telkkleskinkvfsTpipfsysKNLDCWVD<br>NEEDIDVILKKSTILNLDINNDIISDISGFNSSVITYPDAQLVPGINGKAIHLVNNESSEVI<br>VHKAMDIEYNDMFNNFTVSFWLRVPKVSASHLEQYGTNEYSIISSMKKHSLSIGSGWSVSLK<br>GNNLIWTLKDSAGEVRQITFRDLPDKFNAYLANKWVFITITNDRLSSANLYINGVLMGSAEI<br>TGLGAIREDNNITLKLDRCNNNNQYVSIDKFRIFCKALNPKEIEKLYTSYLSITFLRDFWGN<br>PLRYDTEYYLIPVASSSKDVQLKNITDYMYLTNAPSYTNGKLNIYYRRLYNGLKFIIKRYTP<br>NNEIDSFVKSGDFIKLYVSYNNNEHIVGYPKDGNAFNNLDRILRVGYNAPGIPLYKKMEAVK<br>LRDLKTYSVQLKLYDDKNASLGLVGTHNGQIGNDPNRDILIASNWYFNHLKDKILGCDWYFV<br>PTDEGWTND |
| 219 | HIV-CA-<br>3H4E-rTT | *PIVQNLQGQMVHQCISPRTLNAWVKVVEEKAFSPEVIPMFSALSCGATPQDLNTMLNTVGGH*<br>*QAAMQMLKETINEEAAEWDRLHPVHAGPIAPGQMREPRGSDIAGTTSTLQEQIGWMTHNPPI*<br>*PVGEIYKRWIILGLNKIVRMYSPTSILDIRQGPKEPFRDYVDRFYKTLRAEQASQEVKNAAT*<br>*ETLLVQNANPDCKTILKALGPGATLEEMMTACQGVGGPGHKARVL*KNLDCWVDNEEDIDVIL<br>KKSTILNLDINNDIISDISGFNSSVITYPDAQLVPGINGKAIHLVNNESSEVIVHKAMDIEY<br>NDMFNNFTVSFWLRVPKVSASHLEQYGTNEYSIISSMKKHSLSIGSGWSVSLKGNNLIWTLK<br>DSAGEVRQITFRDLPDKFNAYLANKWVFITITNDRLSSANLYINGVLMGSAEITGLGAIRED<br>NNITLKLDRCNNNNQYVSIDKFRIFCKALNPKEIEKLYTSYLSITFLRDFWGNPLRYDTEYY<br>LIPVASSSKDVQLKNITDYMYLTNAPSYTNGKLNIYYRRLYNGLKFIIKRYTPNNEIDSFVK<br>SGDFIKLYVSYNNNEHIVGYPKDGNAFNNLDRILRVGYNAPGIPLYKKMEAVKLRDLKTYSV<br>QLKLYDDKNASLGLVGTHNGQIGNDPNRDILIASNWYFNHLKDKILGCDWYFVPTDEGWTND |
| | | Encapsulin |
| 254 | EN-TThc-<br>degly | MEFLKRSFAPLTEKQWQEIDNRAREIFKTQLYGRKFVDVEGPYGWEYAAHPLCEVEVLSDEN<br>EVVKWGLRKSLPLIELRATFTLDLWELDNLECGKPNVDLSSLEETVRKVAEFEDEVIFRGCE<br>KSGVKGLLSFEERKIECGSTPKDLLEAIVRALSIFSKDGIEGPYTLVINTDRWINFLKEEAG<br>HYPLEKRVEECLRGGKIITTPRIEDALVVSERGGDFKLILGQDLSIGYEDREKDAVRLFITE<br>TFTFQVVNPEALILLKFgsgsgsMKNLDCWVDNEEDIDVILKKSTILNLDINNDIISDISGF |

TABLE 1-continued

Exemplary sequences of fusion proteins containing a protein nanoparticle subunit fused to a heterologous carrier protein and optionally a heterologous T-cell helper epitope.

| SEQ ID NO | Name | Sequence |
|---|---|---|
| | | NSAVITYPDAQLVPGINGKAIHLVNNEASEVIVHKAMDIEYNDMFNNFTVSFWLRVPKVSAS HLEQYGTNEYSIISSMKKHSLSIGSGWSVSLKGNNLIWTLKDSAGEVRQITFRDLPDKFNAY LANKWVFITITNDRLSSANLYINGVLMGSAEITGLGAIREDNQITLKLDRCNNNNQYVSIDK FRIFCKALNPKEIEKLYTSYLSITFLRDFWGNPLRYDTEYYLIPVASSSKDVQLKQITDYMY LTNAPSYTNGKLNIYYRRLYNGLKFIIKRYTPNNEIDSFVKSGDFIKLYVSYNNNEHIVGYP KDGNAFNNLDRILRVGYNAPGIPLYKKMEAVKLRDLKTYSVQLKLYDDKQASLGLVGTHNGQ IGNDPNRDILIASNWYFNHLKDKILGCDWYFVPTDEGWTND |
| 255 | EN-CRM197-degly | MEFLKRSFAPLTEKQWQEIDNRAREIFKTQLYGRKFVDVEGPYGWEYAAHPLCEVEVLSDEN EVVKWGLRKSLPLIELRATFTLDLWELDNLECGKPNVDLSSLEETVRKVAEFEDEVIFRGCE KSGVKGLLSFEERKIECGSTPKDLLEAIVRALSIFSKDGIEGPYTLVINTDRWINFLKEEAG HYPLEKRVEECLRGGKIITTPRIEDALVVSERGGDFKLILGQDLSIGYEDREKDAVRLFITE TFTFQVVNPEALILLKFgsgsgsGADDVVDSSKSFVMENFASYHGTKPGYVDSIQKGIQKPK SGTQGNYDDDWKEFYSTDNKYDAAGYSVDNENPLSGKAGGVVKVTYPGLTKVLALKVDNAET IKKELGLSLTEPLMEQVGTEEFIKRFGDGASRVVLSLPFAEGSSSVEYINNWEQAKALSVEL EINFETRGKRGQDAMYEYMAQACAGNRVRRSVGSSLSCINLDWDVIRDKTKTKIESLKEHGP IKNKMSESPNKAVSEEKAKQYLEEFHQTALEHPELSELKTVTGTNPVFAGANYAAWAVNVAQ VIDSETADNLEKTTAALSILPGIGSVMGIADGAVHHNTEEIVAQSIALSSLMVAQAIPLVGE LVDIGFAAYNFVESIINLFQVVHNSYNRPAYSPGHKTQPFLHDGYAVSWNTVEDSIIRTGFQ GESGHDIKITAENTPLPIAGVLLPTIPGKLDVNKAKTHISVNGRKIRMRCRAIDGDVTFCRP KSPVYVGNGVHANLHVAFHRSSSEKIHSNEISSDSIGVLGYQKTVDHTKVNSKLSLFFEIKS |
| 256 | EN-2xCRM197-degly | MEFLKRSFAPLTEKQWQEIDNRAREIFKTQLYGRKFVDVEGPYGWEYAAHPLCEVEVLSDEN EVVKWGLRKSLPLIELRATFTLDLWELDNLECGKPNVDLSSLEETVRKVAEFEDEVIFRGCE KSGVKGLLSFEERKIECGSTPKDLLEAIVRALSIFSKDGIEGPYTLVINTDRWINFLKEEAG HYPLEKRVEECLRGGKIITTPRIEDALVVSERGGDFKLILGQDLSIGYEDREKDAVRLFITE TFTFQVVNPEALILLKFgsgGADDVVDSSKSFVMENFASYHGTKPGYVDSI QKGIQKPKSGTQGNYDDDWKEFYSTDNKYDAAGYSVDNENPLSGKAGGVVKVTYPGLTKVLA LKVDNAETIKKELGLSLTEPLMEQVGTEEFIKRFGDGASRVVLSLPFAEGSSSVEYINNWEQ AKALSVELEINFETRGKRGQDAMYEYMAQACAGNRVRRSVGSSLSCINLDWDVIRDKTKTKI ESLKEHGPIKNKMSESPNKAVSEEKAKQYLEEFHQTALEHPELSELKTVTGTNPVFAGANYA AWAVNVAQVIDSETADNLEKTTAALSILPGIGSVMGIADGAVHHNTEEIVAQSIALSSLMVA QAIPLVGELVDIGFAAYNFVESIINLFQVVHNSYNRPAYSPGHKTQPFLHDGYAVSWNTVED SIIRTGFQGESGHDIKITAENTPLPIAGVLLPTIPGKLDVNKAKTHISVNGRKIRMRCRAID GDVTFCRPKSPVYVGNGVHANLHVAFHRSSSEKIHSNEISSDSIGVLGYQKTVDHTKVNSKL SLFFEIKSgggsggggsGADDVVDSSKSFVMENFASYHGTKPGYVDSIQKGIQKPKSGTQGNY DDDWKEFYSTDNKYDAAGYSVDNENPLSGKAGGVVKVTYPGLTKVLALKVDNAETIKKELGL SLTEPLMEQVGTEEFIKRFGDGASRVVLSLPFAEGSSSVEYINNWEQAKALSVELEINFETR GKRGQDAMYEYMAQACAGNRVRRSVGSSLSCINLDWDVIRDKTKTKIESLKEHGPIKNKMSE SPNKAVSEEKAKQYLEEFHQTALEHPELSELKTVTGTNPVFAGANYAAWAVNVAQVIDSETA DNLEKTTAALSILPGIGSVMGIADGAVHHNTEEIVAQSIALSSLMVAQAIPLVGELVDIGFA AYNFVESIINLFQVVHNSYNRPAYSPGHKTQPFLHDGYAVSWNTVEDSIIRTGFQGESGHDI KITAENTPLPIAGVLLPTIPGKLDVNKAKTHISVNGRKIRMRCRAIDGDVTFCRPKSPVYVG NGVHANLHVAFHRSSSEKIHSNEISSDSIGVLGYQKTVDHTKVNSKLSLFFEIKS |
| 257 | EN-HID | MEFLKRSFAPLTEKQWQEIDNRAREIFKTQLYGRKFVDVEGPYGWEYAAHPLCEVEVLSDEN EVVKWGLRKSLPLIELRATFTLDLWELDNLECGKPNVDLSSLEETVRKVAEFEDEVIFRGCE KSGVKGLLSFEERKIECGSTPKDLLEAIVRALSIFSKDGIEGPYTLVINTDRWINFLKEEAG HYPLEKRVEECLRGGKIITTPRIEDALVVSERGGDFKLILGQDLSIGYEDREKDAVRLFITE TFTFQVVNPEALILLKFgsgDYKDDDDKgsgsnmantqmksdkiiiahrgasgylpehtles kalafaqqadyleqdlamtkdgrlvvihdhfldgltdvakkfphrhrkdgryyvidftlkei qslemtenfetkdgkqaqvypnrfplwkshfrihtfedeiefiqglekstgkkvgiypeika pwfhhqngkdiaaetlkvlkkygydkktdmvylqtfdfnelkriktellpqmgmdlklvqli aytdwketqekdpkgywynynydwmfkpgamaevvkyadgvgpgwymlvnkeeskpdnivyt plvkelaqynvevhpytvrkdalpefftdvnqmydallnksgatgvftdfpdtgveflkgik |
| 369 | EN - glyser-G53C/K96C-rTT | MEFLKRSFAPLTEKQWQEIDNRAREIFKTQLYGRKFVDVEGPYGWEYAAHPLCEVEVLSDEN EVVKWGLRKSLPLIELRATFTLDLWELDNLECGKPNVDLSSLEETVRKVAEFEDEVIFRGCE KSGVKGLLSFEERKIECGSTPKDLLEAIVRALSIFSKDGIEGPYTLVINTDRWINFLKEEAG HYPLEKRVEECLRGGKIITTPRIEDALVVSERGGDFKLILGQDLSIGYEDREKDAVRLFITE TFTFQVVNPEALILLKFgggsgggsgggsKnldcwvdneedidvilkkstilnldinndiis disgfnssvitypdaqlvpgingkaihlvnnesseviivhkamdieyndmfnnftvsfwlrvp kvsashleqygtneysiissmkkhslsigsgwsyslkgnnliwtlkdsagevrqitfrdlpd kfnaylankwvfititndrlssanlyingvlmgsaeitglgairednnitlkldrcnnnnqy vsidkfrifckalnpkeieklytsylsitfrdfwgnplrydteyylipvasssdvqlkni tdymyltnapsytngklniyyrrlynglkfiikrytpnneidsfvksgdfiklyvsynnneh ivgypkdgnafnnldrilrvgynapgiplykkmeavklrdlktysvqlklyddknaslglvg thngqigndpnrdiliasnwyfnhlkdkilgcdwyfvptdegwtnd |
| 370 | EN - glyser-G53C/K96C - rTT | MEFLKRSFAPLTEKQWQEIDNRAREIFKTQLYGRKFVDVEGPYGWEYAAHPLCEVEVLSDEN EVVKWGLRKSLPLIELRATFTLDLWELDNLECGKPNVDLSSLEETVRKVAEFEDEVIFRGCE KSGVKGLLSFEERKIECGSTPKDLLEAIVRALSIFSKDGIEGPYTLVINTDRWINFLKEEAG HYPLEKRVEECLRGGKIITTPRIEDALVVSERGGDFKLILGQDLSIGYEDREKDAVRLFITE TFTFQVVNPEALILLKFgggsgggsgggslrdfwgnplrydteyylipvassskdvqlknit |

TABLE 1-continued

Exemplary sequences of fusion proteins containing a protein nanoparticle subunit fused to a heterologous carrier protein and optionally a heterologous T-cell helper epitope.

| SEQ ID NO | Name | Sequence |
|---|---|---|
| | | dymyltnapsytngklniyyrrlynglkfiikrytpnneidsfvksgdfiklyvsynnnehi vgypkdgnafnnldrilrvgynapgiplykkmeavklrdlktysvqlklyddknaslglvgt hngqigndpnrdiliasnwyfnhlkdkilgcdwyfvptdegwtnd |
| 371 | EN - glyser- G53C/K96C - rTT N249 | MEFLKRSFAPLTEKQWQEIDNRAREIFKTQLYGRKFVDVEGPYGWEYAAHPLCEVEVLSDEN EVVKWGLRKSLPLIELRATFTLDLWELDNLECGKPNVDLSSLEETVRKVAEFEDEVIFRGCE KSGVKGLLSFEERKIECGSTPKDLLEAIVRALSIFSKDGIEGPYTLVINTDRWINFLKEEAG HYPLEKRVEECLRGGKIITTPRIEDALVVSERGGDFKLILGQDLSIGYEDREKDAVRLFITE TFTFQVVNPEALILLKFgggsgggsgggs knldcwvdneedidvilkkstilnldinndiisdisgfnssvitypdaqlvpgingkaihlv nnessevivhkamdieyndmfnnftvsfwlrvpkvsashleqygtneysiissmkkhslsig sgwsyslkgnnliwtlkdsagevrqitfrdlpdkfnaylankwvfititndrlssanlying vlmgsaeitglgairednnitlkldrcnnnnqyvsidkfrifckalnpkeieklytsylsit |
| 372 | EN - glyser- G53C/K96C - rTT N193 | MEFLKRSFAPLTEKQWQEIDNRAREIFKTQLYGRKFVDVEGPYGWEYAAHPLCEVEVLSDEN EVVKWGLRKSLPLIELRATFTLDLWELDNLECGKPNVDLSSLEETVRKVAEFEDEVIFRGCE KSGVKGLLSFEERKIECGSTPKDLLEAIVRALSIFSKDGIEGPYTLVINTDRWINFLKEEAG HYPLEKRVEECLRGGKIITTPRIEDALVVSERGGDFKLILGQDLSIGYEDREKDAVRLFITE TFTFQVVNPEALILLKFgggsgggsgggsknldcwvdneedidvilkkstilnldinndiis disgfnssvitypdaqlvpgingkaihlvnnessevivhkamdieyndmfnnftvsfwlrvp kvsashleqygtneysiissmkkhslsigsgwsvslkgnnliwtlkdsagevrqitfrdlpd kfnaylankwvfititndrlssanlyingvlmgsae |
| 373 | EN - glyser- G53C/K96C - rTT N87 | MEFLKRSFAPLTEKQWQEIDNRAREIFKTQLYGRKFVDVEGPYGWEYAAHPLCEVEVLSDEN EVVKWGLRKSLPLIELRATFTLDLWELDNLECGKPNVDLSSLEETVRKVAEFEDEVIFRGCE KSGVKGLLSFEERKIECGSTPKDLLEAIVRALSIFSKDGIEGPYTLVINTDRWINFLKEEAG HYPLEKRVEECLRGGKIITTPRIEDALVVSERGGDFKLILGQDLSIGYEDREKDAVRLFITE TFTFQVVNPEALILLKFgggsgggsgggsKnldcwvdneedidvilkkstilnldinndiis disgfnssvitypdaqlvpgingkaihlvnnessevivhkamdieyndmfnnf |
| 374 | EN - glyser- K146/A185C - rTT N87 | MEFLKRSFAPLTEKQWQEIDNRAREIFKTQLYGRKFVDVEGPYGWEYAAHPLCEVEVLSDEN EVVKWGLRKSLPLIELRATFTLDLWELDNLErGcPNVDLSSLEETVRKVAEFEDEVIFRGCE KSGVKGLLSFEERKIECGSTPKDLLEAIVRALSIFSKDGIEGPYTLVINTDRWINFLKEEAG HYPLEKRVEECLRGGKIITTPRIEDALVVSERGGDFKLILGQDLSIGYEDREKDAVRLFITE TFTFQVVNPEALILLKFgggsgggsgggsKnldcwvdneedidvilkkstilnldinndiis disgfnssvitypdaqlvpgingkaihlvnnessevivhkamdieyndmfnnf |
| 375 | EN - glyser- G53C/K96C - rTT N87 | MEFLKRSFAPLTEKQWQEIDNRAREIFKTQLYGRKFVDVEGPYGWEYAAHPLgEVEVLSDEN EVVKWGLRKSLPLIELRATFTLDLWELDNLErGkPNVDLSSLEETVRKVAEFEDEVIFRGCE KSGVKGLLSFEERKIECGSTPcDLLEAIVRALSIFSKDGIEGPYTLVINTDRWINFLKEEcG HYPLEKRVEECLRGGKIITTPRIEDALVVSERGGDFKLILGQDLSIGYEDREKDAVRLFITE TFTFQVVNPEALILLKFgggsgggsgggsKnldcwvdneedidvilkkstilnldinndiis disgfnssvitypdaqlvpgingkaihlvnnessevivhkamdieyndmfnnf |
| 376 | EN - caIgG2a- G53C/K96C - rTT N88 | MEFLKRSFAPLTEKQWQEIDNRAREIFKTQLYGRKFVDVEGPYGWEYAAHPLCEVEVLSDEN EVVKWGLRKSLPLIELRATFTLDLWELDNLECGKPNVDLSSLEETVRKVAEFEDEVIFRGCE KSGVKGLLSFEERKIECGSTPKDLLEAIVRALSIFSKDGIEGPYTLVINTDRWINFLKEEAG HYPLEKRVEECLRGGKIITTPRIEDALVVSERGGDFKLILGQDLSIGYEDREKDAVRLFITE TFTFQVVNPEALILLKFggEPKIPQPQPKPQPQPQPKPQPKPEPEggKnldcwvdneedi dvilkkstilnldinndiisdisgfnssvitypdaqlvpgingkaihlvnnessevivhkam dieyndmfnnf |
| 377 | EN -CD8- G53C/K96C- rTT N88 | MEFLKRSFAPLTEKQWQEIDNRAREIFKTQLYGRKFVDVEGPYGWEYAAHPLCEVEVLSDEN EVVKWGLRKSLPLIELRATFTLDLWELDNLECGKPNVDLSSLEETVRKVAEFEDEVIFRGCE KSGVKGLLSFEERKIECGSTPKDLLEAIVRALSIFSKDGIEGPYTLVINTDRWINFLKEEAG HYPLEKRVEECLRGGKIITTPRIEDALVVSERGGDFKLILGQDLSIGYEDREKDAVRLFITE TFTFQVVNPEALILLKFggKPTTTPAPRPPTPAPTIASQPLSLRPEACRPAAGGAVHTRGLD FACDggKnldcwvdneedidvilkkstilnldinndiisdisgfnssvitypdaqlvpging kaihlvnnessevivhkamdieyndmfnnf |
| 378 | EN - hinge- G53C/K96C- rTT N88 | MEFLKRSFAPLTEKQWQEIDNRAREIFKTQLYGRKFVDVEGPYGWEYAAHPLCEVEVLSDEN EVVKWGLRKSLPLIELRATFTLDLWELDNLECGKPNVDLSSLEETVRKVAEFEDEVIFRGCE KSGVKGLLSFEERKIECGSTPKDLLEAIVRALSIFSKDGIEGPYTLVINTDRWINFLKEEAG HYPLEKRVEECLRGGKIITTPRIEDALVVSERGGDFKLILGQDLSIGYEDREKDAVRLFITE TFTFQVVNPEALILLKFggEPKSDKTHTPPPAPELLgsgEPKSDKTHTPPPAPELLggKnld cwvdneedidvilkkstilnldinndiisdisgfnssvitypdaqlvpgingkaihlvnnes sevivhkamdieyndmfnnf |
| | HBV | |
| 379 | rTT- hinge-HBV P25C/R127C | KNLDCWVDNEEDIDVILKKSTILNLDINNDIISDISGFNSSVITYPDAQLVPGINGKAIHLV NNESSEVIVHKAMDIEYNDMFNNFTVSFWLRVPKVSASHLEQYGTNEYSIISSMKKHSLSIG SGWSVSLKGNNLIWTLKDSAGEVRQITFRDLPDKFNAYLANKWVFITITNDRLSSANLYING VLMGSAEITGLGAIREDNNITLKDRCNNNQYVSIDKFRIFCKALNPKEIEKLYTSYLSIT |

TABLE 1-continued

Exemplary sequences of fusion proteins containing a protein nanoparticle subunit fused to a heterologous carrier protein and optionally a heterologous T-cell helper epitope.

| SEQ ID NO | Name | Sequence |
|---|---|---|
| | | FLRDFWGNPLRYDTEYYLIPVASSSKDVQLKNITDYMYLTNAPSYTNGKLNIYYRRLYNGLK FIIKRYTPNNEIDSFVKSGDFIKLYVSYNNNEHIVGYPKDGNAFNNLDRILRVGYNAPGIPL YKKMEAVKLRDLKTYSVQLKLYDDKNASLGLVGTHNGQIGNDPNRDILIASNWYFNHLKDKI LGCDWYFVPTDEGWTNDggsgEPKSDKTHTPPPAPELLgsgEPKSDKTHTPPPAPELLgsgg MDIDPYKEFGATVELLSFLPSDFFcSVRDLLDTASALYREALESPEHCSPHHTALRQAILCW GELMTLATWVGVNLEDPASRDLVVSYVNTNMGLKFRQLLWFHISCLTFGRETVIEYLVSFGV WIcTPPAYRPPNAPILSTLPETTVVRRRGRSPRRRTPSPRRRRSQSPRRRRSQSRESQC |
| 380 | rTT-hinge-HBV E14C/A36C | KNLDCWVDNEEDIDVILKKSTILNLDINNDIISDISGFNSSVITYPDAQLVPGINGKAIHLV NNESSEVIVHKAMDIEYNDMFNNFTVSFWLRVPKVSASHLEQYGTNEYSIISSMKKHSLSIG SGWSVSLKGNNLIWTLKDSAGEVRQITFRDLPDKFNAYLANKWVFITITNDRLSSANLYING VLMGSAEITGLGAIREDNNITLKLDRCNNNNQYVSIDKFRIFCKALNPKEIEKLYTSYLSIT FLRDFWGNPLRYDTEYYLIPVASSSKDVQLKNITDYMYLTNAPSYTNGKLNIYYRRLYNGLK FIIKRYTPNNEIDSFVKSGDFIKLYVSYNNNEHIVGYPKDGNAFNNLDRILRVGYNAPGIPL YKKMEAVKLRDLKTYSVQLKLYDDKNASLGLVGTHNGQIGNDPNRDILIASNWYFNHLKDKI LGCDWYFVPTDEGWTNDggsgEPKSDKTHTPPPAPELLgsgEPKSDKTHTPPPAPELLgsgg MDIDPYKEFGATVcLLSFLPSDFFPSVRDLLDTAScLYREALESPEHCSPHHTALRQAILCW GELMTLATWVGVNLEDPASRDLVVSYVNTNMGLKFRQLLWFHISCLTFGRETVIEYLVSFGV WIRTPPAYRPPNAPILSTLPETTVVRRRGRSPRRRTPSPRRRRSQSPRRRRSQSRESQC |
| 381 | rTT-hinge-HBV D29C/R127C | KNLDCWVDNEEDIDVILKKSTILNLDINNDIISDISGFNSSVITYPDAQLVPGINGKAIHLV NNESSEVIVHKAMDIEYNDMFNNFTVSFWLRVPKVSASHLEQYGTNEYSIISSMKKHSLSIG SGWSVSLKGNNLIWTLKDSAGEVRQITFRDLPDKFNAYLANKWVFITITNDRLSSANLYING VLMGSAEITGLGAIREDNNITLKLDRCNNNNQYVSIDKFRIFCKALNPKEIEKLYTSYLSIT FLRDFWGNPLRYDTEYYLIPVASSSKDVQLKNITDYMYLTNAPSYTNGKLNIYYRRLYNGLK FIIKRYTPNNEIDSFVKSGDFIKLYVSYNNNEHIVGYPKDGNAFNNLDRILRVGYNAPGIPL YKKMEAVKLRDLKTYSVQLKLYDDKNASLGLVGTHNGQIGNDPNRDILIASNWYFNHLKDKI LGCDWYFVPTDEGWTNDggsgEPKSDKTHTPPPAPELLgsgEPKSDKTHTPPPAPELLgsgg MDIDPYKEFGATVELLSFLPSDFFPSVRcLLDTASALYREALESPEHCSPHHTALRQAILCW GELMTLATWVGVNLEDPASRDLVVSYVNTNMGLKFRQLLWFHISCLTFGRETVIEYLVSFGV WIcTPPAYRPPNAPILSTLPETTVVRRRGRSPRRRTPSPRRRRSQSPRRRRSQSRESQC |
| 382 | rTT-caIgG2a-HBV P25C/R127C | KNLDCWVDNEEDIDVILKKSTILNLDINNDIISDISGFNSSVITYPDAQLVPGINGKAIHLV NNESSEVIVHKAMDIEYNDMFNNFTVSFWLRVPKVSASHLEQYGTNEYSIISSMKKHSLSIG SGWSVSLKGNNLIWTLKDSAGEVRQITFRDLPDKFNAYLANKWVFITITNDRLSSANLYING VLMGSAEITGLGAIREDNNITLKLDRCNNNNQYVSIDKFRIFCKALNPKEIEKLYTSYLSIT FLRDFWGNPLRYDTEYYLIPVASSSKDVQLKNITDYMYLTNAPSYTNGKLNIYYRRLYNGLK FIIKRYTPNNEIDSFVKSGDFIKLYVSYNNNEHIVGYPKDGNAFNNLDRILRVGYNAPGIPL YKKMEAVKLRDLKTYSVQLKLYDDKNASLGLVGTHNGQIGNDPNRDILIASNWYFNHLKDKI LGCDWYFVPTDEGWTNDgsgGSEPKIPQPQPKPQPQPQPQPKPQPKPEPEgsgMDIDPYKEF GATVELLSFLPSDFFcSVRDLLDTASALYREALESPEHCSPHHTALRQAILCWGELMTLATW VGVNLEDPASRDLVVSYVNTNMGLKFRQLLWFHISCLTFGRETVIEYLVSFGVWIcTPPAYR PPNAPILSTLPETTVVRRRGRSPRRRTPSPRRRRSQSPRRRRSQSRESQC |
| 383 | rTT-caIgG2a-HBV E14C/A36C | KNLDCWVDNEEDIDVILKKSTILNLDINNDIISDISGFNSSVITYPDAQLVPGINGKAIHLV NNESSEVIVHKAMDIEYNDMFNNFTVSFWLRVPKVSASHLEQYGTNEYSIISSMKKHSLSIG SGWSVSLKGNNLIWTLKDSAGEVRQITFRDLPDKFNAYLANKWVFITITNDRLSSANLYING VLMGSAEITGLGAIREDNNITLKLDRCNNNNQYVSIDKFRIFCKALNPKEIEKLYTSYLSIT FLRDFWGNPLRYDTEYYLIPVASSSKDVQLKNITDYMYLTNAPSYTNGKLNIYYRRLYNGLK FIIKRYTPNNEIDSFVKSGDFIKLYVSYNNNEHIVGYPKDGNAFNNLDRILRVGYNAPGIPL YKKMEAVKLRDLKTYSVQLKLYDDKNASLGLVGTHNGQIGNDPNRDILIASNWYFNHLKDKI LGCDWYFVPTDEGWTNDgsgGSEPKIPQPQPKPQPQPQPQPKPQPKPEPEgsgMDIDPYKEF GATVcLLSFLPSDFFPSVRDLLDTAScLYREALESPEHCSPHHTALRQAILCWGELMTLATW VGVNLEDPASRDLVVSYVNTNMGLKFRQLLWFHISCLTFGRETVIEYLVSFGVWIRTPPAYR PPNAPILSTLPETTVVRRRGRSPRRRTPSPRRRRSQSPRRRRSQSRESQC |
| 384 | rTT-caIgG2a-HBV D29C/R127C | KNLDCWVDNEEDIDVILKKSTILNLDINNDIISDISGFNSSVITYPDAQLVPGINGKAIHLV NNESSEVIVHKAMDIEYNDMFNNFTVSFWLRVPKVSASHLEQYGTNEYSIISSMKKHSLSIG SGWSVSLKGNNLIWTLKDSAGEVRQITFRDLPDKFNAYLANKWVFITITNDRLSSANLYING VLMGSAEITGLGAIREDNNITLKLDRCNNNNQYVSIDKFRIFCKALNPKEIEKLYTSYLSIT FLRDFWGNPLRYDTEYYLIPVASSSKDVQLKNITDYMYLTNAPSYTNGKLNIYYRRLYNGLK FIIKRYTPNNEIDSFVKSGDFIKLYVSYNNNEHIVGYPKDGNAFNNLDRILRVGYNAPGIPL YKKMEAVKLRDLKTYSVQLKLYDDKNASLGLVGTHNGQIGNDPNRDILIASNWYFNHLKDKI LGCDWYFVPTDEGWTNDgsgGSEPKIPQPQPKPQPQPQPQPKPQPKPEPEgsgMDIDPYKEF GATVELLSFLPSDFFPSVRcLLDTASALYREALESPEHCSPHHTALRQAILCWGELMTLATW VGVNLEDPASRDLVVSYVNTNMGLKFRQLLWFHISCLTFGRETVIEYLVSFGVWIcTPPAYR PPNAPILSTLPETTVVRRRGRSPRRRTPSPRRRRSQSPRRRRSQSRESQC |
| 385 | rTT-CD8-HBV P25C/R127C | KNLDCWVDNEEDIDVILKKSTILNLDINNDIISDISGFNSSVITYPDAQLVPGINGKAIHLV NNESSEVIVHKAMDIEYNDMFNNFTVSFWLRVPKVSASHLEQYGTNEYSIISSMKKHSLSIG SGWSVSLKGNNLIWTLKDSAGEVRQITFRDLPDKFNAYLANKWVFITITNDRLSSANLYING VLMGSAEITGLGAIREDNNITLKLDRCNNNNQYVSIDKFRIFCKALNPKEIEKLYTSYLSIT FLRDFWGNPLRYDTEYYLIPVASSSKDVQLKNITDYMYLTNAPSYTNGKLNIYYRRLYNGLK FIIKRYTPNNEIDSFVKSGDFIKLYVSYNNNEHIVGYPKDGNAFNNLDRILRVGYNAPGIPL |

TABLE 1-continued

Exemplary sequences of fusion proteins containing a protein nanoparticle subunit fused to a heterologous carrier protein and optionally a heterologous T-cell helper epitope.

| SEQ ID NO | Name | Sequence |
|---|---|---|
| | | YKKMEAVKLRDLKTYSVQLKLYDDKNASLGLVGTHNGQIGNDPNRDILIASNWYFNHLKDKILGCDWYFVPTDEGWTNDgsggsgKPTTTPAPRPPTPAPTIASQPLSLRPEACRPAAGGAVHTRGLDFACDgsgMDIDPYKEFGATVELLSFLPSDFFcSVRDLLDTASALYREALESPEHCSPHHTALRQAILCWGELMTLATWVGVNLEDPASRDLVVSYVNTNMGLKFRQLLWFHISCLTFGRETVIEYLVSFGVWIcTPPAYRPPNAPILSTLPETTVVRRRGRSPRRRTPSPRRRRSQSPRRRRSQSRESQC |
| 386 | rTT-CD8-HBV E14C/A36C | KNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTNDgsggsgKPTTTPAPRPPTPAPTIASQPLSLRPEACRPAAGGAVHTRGLDFACDgsgMDIDPYKEFGATVcLLSFLPSDFFPSVRDLLDTAScLYREALESPEHCSPHHTALRQAILCWGELMTLATWVGVNLEDPASRDLVVSYVNTNMGLKFRQLLWFHISCLTFGRETVIEYLVSFGVWIRTPPAYRPPNAPILSTLPETTVVRRRGRSPRRRTPSPRRRRSQSPRRRRSQSRESQC |
| 387 | rTT-CD8-HBV D29C/R127C | KNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTNDgsggsgKPTTTPAPRPPTPAPTIASQPLSLRPEACRPAAGGAVHTRGLDFACDgsgMDIDPYKEFGATVELLSFLPSDFFPSVRcLLDTASALYREALESPEHCSPHHTALRQAILCWGELMTLATWVGVNLEDPASRDLVVSYVNTNMGLKFRQLLWFHISCLTFGRETVIEYLVSFGVWIcTPPAYRPPNAPILSTLPETTVVRRRGRSPRRRTPSPRRRRSQSPRRRRSQSRESQC |
| | | AP205 |
| 388 | AP205-glyser-rTT | MANKPMQPITSTANKIVWSDPTRLSTTFSASLLRQRVKVGIAELNNVSGQYVSVYKRPAPKPEGCADACVIMPNENQSIRTVISGSAENLATLKAEWETHKRNVDTLFASGNAGLGFLDPTAAIVSSDTTgggsgggsgggsKnldcwvdneedidvilkkstilnldinndiisdisgfnssvitypdaqlvpgingkaihlvnnessevivhkamdieyndmfnnftvsfwlrvpkvsashleqygtneysiissmkkhslsigsgwsyslkgnnliwtlkdsagevrqitfrdlpdkfnaylankwvfititndrlssanlyingvlmgsaeitglgairednnitlkldrcnnnnqyvsidkfrifckalnpkeieklytsylsitflrdfwgnplrydteyylipvassskdvqlknitdymyltnapsytngklniyyrrlynglkfiikrytpnneidsfyksgdfiklyvsynnnehivgypkdgnafnnldrilrvgynapgiplykkmeavklrdlktysvqlklyddknaslglvgthngqigndpnrdiliasnwyfnhlkdkilgcdwyfvptdegwtnd |
| 389 | AP205-glyser-rTT N193 | MANKPMQPITSTANKIVWSDPTRLSTTFSASLLRQRVKVGIAELNNVSGQYVSVYKRPAPKPEGCADACVIMPNENQSIRTVISGSAENLATLKAEWETHKRNVDTLFASGNAGLGFLDPTAAIVSSDTTgggsgggsgggsknldcwvdneedidvilkkstilnldinndiisdisgfnssvitypdaqlvpgingkaihlvnnessevivhkamdieyndmfnnftvsfwlrvpkvsashleqygtneysiissmkkhslsigsgwsyslkgnnliwtlkdsagevrqitfrdlpdkfnaylankwvfititndrlssanlyingvlmgsae |
| 390 | AP205-glyser-rTT N87 | MANKPMQPITSTANKIVWSDPTRLSTTFSASLLRQRVKVGIAELNNVSGQYVSVYKRPAPKPEGCADACVIMPNENQSIRTVISGSAENLATLKAEWETHKRNVDTLFASGNAGLGFLDPTAAIVSSDTTgggsgggsgggsKnldcwvdneedidvilkkstilnldinndiisdisgfnssvitypdaqlvpgingkaihlvnnessevivhkamdieyndmfnnf |
| 391 | AP205-caIgG2a-rTT N87 | MANKPMQPITSTANKIVWSDPTRLSTTFSASLLRQRVKVGIAELNNVSGQYVSVYKRPAPKPEGCADACVIMPNENQSIRTVISGSAENLATLKAEWETHKRNVDTLFASGNAGLGFLDPTAAIVSSDTTgsgEPKIPQPQPKPQPQPQPQPKPQPKPEPEgsgKnldcwvdneedidvilkkstilnldinndiisdisgfnssvitypdaqlvpgingkaihlvnnessevivhkamdieyndmfnnf |
| 392 | AP205-CD8-rTT N87 | MANKPMQPITSTANKIVWSDPTRLSTTFSASLLRQRVKVGIAELNNVSGQYVSVYKRPAPKPEGCADACVIMPNENQSIRTVISGSAENLATLKAEWETHKRNVDTLFASGNAGLGFLDPTAAIVSSDTTgsgKPTTTPAPRPPTPAPTIASQPLSLRPEACRPAAGGAVHTRGLDFACDgsgKnldcwvdneedidvilkkstilnldinndiisdisgfnssvitypdaqlvpgingkaihlvnnessevivhkamdieyndmfnnf |
| 393 | AP205-hinge-rTT N87 | MANKPMQPITSTANKIVWSDPTRLSTTFSASLLRQRVKVGIAELNNVSGQYVSVYKRPAPKPEGCADACVIMPNENQSIRTVISGSAENLATLKAEWETHKRNVDTLFASGNAGLGFLDPTAAIVSSDTTgsgEPKSDKTHTPPPAPELLgsgEPKSDKTHTPPPAPELLgsgKnldcwvdneedi |

TABLE 1-continued

Exemplary sequences of fusion proteins containing a protein nanoparticle subunit fused to a heterologous carrier protein and optionally a heterologous T-cell helper epitope.

| SEQ ID NO | Name | Sequence |
|---|---|---|
| | | dvilkkstilnldinndiisdisgfnssvitypdaqlvpgingkaihlvnnessevivhkam dieyndmfnnf |
| 394 | AP205 T81C-hinge-rTT N87 | MANKPMQPITSTANKIVWSDPTRLSTTFSASLLRQRVKVGIAELNNVSGQYVSVYKRPAPKP EGCADACVIMPNENQSIRcVISGSAENLATLKAEWETHKRNVDTLFASGNAGLGFLDPTAAI VSSDTTgsgEPKSDKTHTPPPAPELLgsgEPKSDKTHTPPPAPELLgsgKnldcwvdneedi dvilkkstilnldinndiisdisgfnssvitypdaqlvpgingkaihlvnnessevivhkam dieyndmfnnf |
| 395 | AP205 S53C/H100C-hinge-rTT N87 | MANKPMQPITSTANKIVWSDPTRLSTTFSASLLRQRVKVGIAELNNVSGQYVVYcKRPAPKP EGCADACVIMPNENQSIRTVISGSAENLATLKAEWETcKRNVDTLFASGNAGLGFLDPTAAI VSSDTTgsgEPKSDKTHTPPPAPELLgsgEPKSDKTHTPPPAPELLgsgKnldcwvdneedi dvilkkstilnldinndiisdisgfnssvitypdaqlvpgingkaihlvnnessevivhkam dieyndmfnnf |
| 396 | AP205 V82C/R80C-hinge-rTT N87 | MANKPMQPITSTANKIVWSDPTRLSTTFSASLLRQRVKVGIAELNNVSGQYVSVYKRPAPKP EGCADACVIMPNENQSIctcISGSAENLATLKAEWETHKRNVDTLFASGNAGLGFLDPTAAI VSSDTTgsgEPKSDKTHTPPPAPELLgsgEPKSDKTHTPPPAPELLgsgKnldcwvdneedi dvilkkstilnldinndiisdisgfnssvitypdaqlvpgingkaihlvnnessevivhkam dieyndmfnnf |
| 397 | AP205-C65/C69GC-hinge-rTT N87 | MANKPMQPITSTANKIVWSDPTRLSTTFSASLLRQRVKVGIAELNNVSGQYVSVYKRPAPKP EGCADAgCVIMPNENQSIRTVISGSAENLATLKAEWETHKRNVDTLFASGNAGLGFLDPTAA IVSSDTTgsgEPKSDKTHTPPPAPELLgsgEPKSDKTHTPPPAPELLgsgKnldcwvdneed idvilkkstilnldinndiisdisgfnssvitypdaqlvpgingkaihlvnnessevivhka mdieyndmfnnf |

The fusion protein of the self-assembling protein nanoparticle carrier can include various tags and sequences for production and purification. Typically such protein tags are linked to the N- or C-terminus of the monomer and are ultimately removed (for example by selective protease cleave) from the monomer. For production in cells, the fusion protein of the self-assembling protein nanoparticle carrier can further include a signal peptide that is cleaved off during cellular processing. The fusion proteins can be expressed in appropriate cells (e.g., HEK 293 Freestyle cells) and the fusion proteins are secreted from the cells and self-assemble into the protein nanoparticle carrier. The protein nanoparticle carrier can be purified using known techniques, for example by a few different chromatography procedures, e.g. Mono Q (anion exchange) followed by size exclusion (SUPEROSE® 6) chromatography.

B. HIV-1 Env Fusion Peptide

Any combination of HIV-1 Env fusion peptide and self-assembling protein nanoparticle carrier may be selected from the specific HIV-1 Env fusion peptide and self-assembling protein nanoparticle carriers provided herein to generate the immunogenic conjugate.

HIV-1 can be classified into four groups: the "major" group M, the "outlier" group 0, group N, and group P. Within group M, there are several genetically distinct clades (or subtypes) of HIV-1. The HIV-1 Env fusion peptide included in the immunogenic conjugate can be the fusion peptide from any subtype of HIV, such as groups M, N, O, or P or clade A, B, C, D, F, G, H, J or K and the like.

The HIV-1 Env fusion peptide included in the immunogenic conjugate can consist essentially of or consist of residue 512 to one of residues 514-521 (such as residues 512-519) of HIV-1 Env (HXB2) numbering of the Env protein from any subtype of HIV, such as groups M, N, O, or P or clade A, B, C, D, F, G, H, J or K and the like. In some embodiments, the HIV-1 Env fusion peptide included in the immunogenic conjugate can consist essentially of or consist of residue 512 to one of residues 515-521 of HIV-1 Env (HXB2) numbering of the Env protein from any subtype of HIV, such as groups M, N, O, or P or clade A, B, C, D, F, G, H, J or K and the like. In some embodiments, The HIV-1 Env fusion peptide included in the immunogenic conjugate can consist essentially of or consist of residue 512 to one of residues 516-521 of HIV-1 Env (HXB2) numbering of the Env protein from any subtype of HIV, such as groups M, N, O, or P or clade A, B, C, D, F, G, H, J or K and the like. HIV Env fusion peptides from the different HIV Glades, as well as nucleic acid sequences encoding such proteins and methods for the manipulation and insertion of such nucleic acid sequences into vectors, are known (see, e.g., HIV Sequence Compendium, Division of AIDS, National Institute of Allergy and Infectious Diseases (2003); HIV Sequence Database (hiv-web.lanl.gov/content/hiv-db/mainpage.html); Sambrook et al., Molecular Cloning, a Laboratory Manual, 2d edition, Cold Spring Harbor Press, Cold Spring Harbor, N.Y. (1989); Ausubel et al., Current Protocols in Molecular Biology, Greene Publishing Associates and John Wiley & Sons, New York, N.Y. (1994)).

In some embodiments, the HIV-1 Env fusion peptides included in the immunogenic conjugate consists essentially of or consists of from 5 to 10 residues (such as 5, 6, 7, 8, 9, or 10 residues or 7-9 residues or 8-10 residues or 6-8 residues) from the N-terminus of the amino acid sequence set forth as AVGIGAVFLG (SEQ ID NO: 1). These residues correspond to HIV-1 Env positions 512-521 (HXB2 numbering). In some embodiments, the HIV-1 Env fusion peptides included in the immunogenic conjugate consists essentially of or consists of the amino acid sequence set forth as residues 1-8 of SEQ ID NO:1.

In some embodiments, the HIV-1 Env fusion peptides included in the immunogenic conjugate consists essentially of or consists of from 5 to 10 residues (such as 5, 6, 7, 8, 9, or 10 residues or 7-9 residues or 8-10 residues or 6-8 residues) from the N-terminus of the amino acid sequence set forth as AVGLGAVFLG (SEQ ID NO: 2). These residues correspond to HIV-1 Env positions 512-521 (HXB2 numbering). In some embodiments, the HIV-1 Env fusion peptides included in the immunogenic conjugate consists essentially of or consists of the amino acid sequence set forth as residues 1-8 of SEQ ID NO: 2.

In some embodiments, the HIV-1 Env fusion peptides included in the immunogenic conjugate consists essentially of or consists of from 5 to 10 residues (such as 5, 6, 7, 8, 9, or 10 residues or 7-9 residues or 8-10 residues or 6-8 residues) from the N-terminus of the amino acid sequence set forth as AVGIGAMIFG (SEQ ID NO: 3). These residues correspond to HIV-1 Env positions 512-521 (HXB2 numbering). In some embodiments, the HIV-1 Env fusion peptides included in the immunogenic conjugate consists essentially of or consists of the amino acid sequence set forth as residues 1-8 of SEQ ID NO: 3.

In some embodiments, the HIV-1 Env fusion peptides included in the immunogenic conjugate consists essentially of or consists of from 5 to 11 residues (such as 5, 6, 7, 8, 9, 10, or 11 residues or 7-9 residues or 8-10 residues or 6-8 residues) from the N-terminus of the amino acid sequence set forth as AVGTIGAMFLG (SEQ ID NO: 4). These residues correspond to HIV-1 Env positions 512-521 (HXB2 numbering). In some embodiments, the HIV-1 Env fusion peptides included in the immunogenic conjugate consists essentially of or consists of the amino acid sequence set forth as residues 1-8 of SEQ ID NO: 4.

In some embodiments, the HIV-1 Env fusion peptides included in the immunogenic conjugate consists essentially of or consists of from 5 to 10 residues (such as 5, 6, 7, 8, 9, or 10 residues or 7-9 residues or 8-10 residues or 6-8 residues) from the N-terminus of the amino acid sequence set forth as AVGIGAMFLG (SEQ ID NO: 5). These residues correspond to HIV-1 Env positions 512-521 (HXB2 numbering). In some embodiments, the HIV-1 Env fusion peptides included in the immunogenic conjugate consists essentially of or consists of the amino acid sequence set forth as residues 1-8 of SEQ ID NO: 5.

In some embodiments, the HIV-1 Env fusion peptides included in the immunogenic conjugate consists essentially of or consists of from 5 to 10 residues (such as 5, 6, 7, 8, 9, or 10 residues or 7-9 residues or 8-10 residues or 6-8 residues) from the N-terminus of the amino acid sequence set forth as AVGIGALFLG (SEQ ID NO: 6). These residues correspond to HIV-1 Env positions 512-521 (HXB2 numbering). In some embodiments, the HIV-1 Env fusion peptides included in the immunogenic conjugate consists essentially of or consists of the amino acid sequence set forth as residues 1-8 of SEQ ID NO: 6.

In some embodiments, the HIV-1 Env fusion peptides included in the immunogenic conjugate consists essentially of or consists of from 5 to 10 residues (such as 5, 6, 7, 8, 9, or 10 residues or 7-9 residues or 8-10 residues or 6-8 residues) from the N-terminus of the amino acid sequence set forth as AIGLGAMFLG (SEQ ID NO: 7). These residues correspond to HIV-1 Env positions 512-521 (HXB2 numbering). In some embodiments, the HIV-1 Env fusion peptides included in the immunogenic conjugate consists essentially of or consists of the amino acid sequence set forth as residues 1-8 of SEQ ID NO: 7.

In some embodiments, the HIV-1 Env fusion peptides included in the immunogenic conjugate consists essentially of or consists of from 5 to 10 residues (such as 5, 6, 7, 8, 9, or 10 residues or 7-9 residues or 8-10 residues or 6-8 residues) from the N-terminus of the amino acid sequence set forth as AVGLGAVFIG (SEQ ID NO: 8). These residues correspond to HIV-1 Env positions 512-521 (HXB2 numbering). In some embodiments, the HIV-1 Env fusion peptides included in the immunogenic conjugate consists essentially of or consists of the amino acid sequence set forth as residues 1-8 of SEQ ID NO: 8.

In some embodiments, the HIV-1 Env fusion peptides included in the immunogenic conjugate consists essentially of or consists of from 5 to 10 residues (such as 5, 6, 7, 8, 9, or 10 residues or 7-9 residues or 8-10 residues or 6-8 residues) from the N-terminus of the amino acid sequence set forth as AVGIGAVLLG (SEQ ID NO: 9). These residues correspond to HIV-1 Env positions 512-521 (HXB2 numbering). In some embodiments, the HIV-1 Env fusion peptides included in the immunogenic conjugate consists essentially of or consists of the amino acid sequence set forth as residues 1-8 of SEQ ID NO: 9.

In some embodiments, the HIV-1 Env fusion peptides included in the immunogenic conjugate consists essentially of or consists of from 5 to 10 residues (such as 5, 6, 7, 8, 9, or 10 residues or 7-9 residues or 8-10 residues or 6-8 residues) from the N-terminus of the amino acid sequence set forth as AVGIGAVFIG (SEQ ID NO: 10). These residues correspond to HIV-1 Env positions 512-521 (HXB2 numbering). In some embodiments, the HIV-1 Env fusion peptides included in the immunogenic conjugate consists essentially of or consists of the amino acid sequence set forth as residues 1-8 of SEQ ID NO: 10.

In some embodiments, the HIV-1 Env fusion peptides included in the immunogenic conjugate consists essentially of or consists of from 5 to 10 residues (such as 5, 6, 7, 8, 9, or 10 residues or 7-9 residues or 8-10 residues or 6-8 residues) from the N-terminus of the amino acid sequence set forth as AIGLGALFLG (SEQ ID NO: 11). These residues correspond to HIV-1 Env positions 512-521 (HXB2 numbering). In some embodiments, the HIV-1 Env fusion peptides included in the immunogenic conjugate consists essentially of or consists of the amino acid sequence set forth as residues 1-8 of SEQ ID NO: 11.

In some embodiments, the HIV-1 Env fusion peptides included in the immunogenic conjugate consists essentially of or consists of from 5 to 9 residues (such as 5, 6, 7, 8, or 9 residues or 7-9 residues or 8-9 residues or 6-8 residues) from the N-terminus of the amino acid sequence set forth as AALGAVFLG (SEQ ID NO: 12). These residues correspond to HIV-1 Env positions 512-521 (HXB2 numbering). In some embodiments, the HIV-1 Env fusion peptides included in the immunogenic conjugate consists essentially of or consists of the amino acid sequence set forth as residues 1-8 of SEQ ID NO: 12.

In some embodiments, the immunogenic conjugate comprises any of the above HIV-1 Env fusion peptides (such as AVGIGAVF, residues 1-8 of SEQ ID NO: 1) conjugated to a self-assembling protein nanoparticle carrier formed from fusion proteins comprising a tetanus toxoid heavy chain C fragment and a lumazine synthase nanoparticle subunit, wherein the HIV-1 Env fusion peptides are conjugated to the self-assembling protein nanoparticle carrier by linkers between lysine residues on the self-assembling protein nanoparticle carrier and a heterologous cysteine residue fused to a C-terminal residue of the HIV-1 Env fusion peptides.

In some embodiments, the immunogenic conjugate comprises any of the above HIV-1 Env fusion peptides (such as AVGIGAVF, residues 1-8 of SEQ ID NO: 1) conjugated to a self-assembling protein nanoparticle carrier formed from fusion proteins comprising *H. influenzae* protein D (HiD) and a lumazine synthase nanoparticle subunit, wherein the HIV-1 Env fusion peptides are conjugated to the self-assembling protein nanoparticle carrier by linkers between lysine residues on the self-assembling protein nanoparticle carrier and a heterologous cysteine residue fused to a C-terminal residue of the HIV-1 Env fusion peptides.

In some embodiments, the immunogenic conjugate comprises any of the above HIV-1 Env fusion peptides (such as AVGIGAVF, residues 1-8 of SEQ ID NO: 1) conjugated to a self-assembling protein nanoparticle carrier formed from fusion proteins comprising diphtheria toxoid or a variant thereof (such as CRM197) and a lumazine synthase nanoparticle subunit, wherein the HIV-1 Env fusion peptides are conjugated to the self-assembling protein nanoparticle carrier by linkers between lysine residues on the self-assembling protein nanoparticle carrier and a heterologous cysteine residue fused to a C-terminal residue of the HIV-1 Env fusion peptides.

In some embodiments, the immunogenic conjugate comprises any of the above HIV-1 Env fusion peptides (such as AVGIGAVF, residues 1-8 of SEQ ID NO: 1) conjugated to a self-assembling protein nanoparticle carrier formed from fusion proteins comprising a tetanus toxoid heavy chain C fragment and a ferritin nanoparticle subunit, wherein the HIV-1 Env fusion peptides are conjugated to the self-assembling protein nanoparticle carrier by linkers between lysine residues on the self-assembling protein nanoparticle carrier and a heterologous cysteine residue fused to a C-terminal residue of the HIV-1 Env fusion peptides.

In some embodiments, the immunogenic conjugate comprises any of the above HIV-1 Env fusion peptides (such as AVGIGAVF, residues 1-8 of SEQ ID NO: 1) conjugated to a self-assembling protein nanoparticle carrier formed from fusion proteins comprising *H. influenzae* protein D (HiD) and a ferritin nanoparticle subunit, wherein the HIV-1 Env fusion peptides are conjugated to the self-assembling protein nanoparticle carrier by linkers between lysine residues on the self-assembling protein nanoparticle carrier and a heterologous cysteine residue fused to a C-terminal residue of the HIV-1 Env fusion peptides.

In some embodiments, the immunogenic conjugate comprises any of the above HIV-1 Env fusion peptides (such as AVGIGAVF, residues 1-8 of SEQ ID NO: 1) conjugated to a self-assembling protein nanoparticle carrier formed from fusion proteins comprising diphtheria toxoid or a variant thereof (such as CRM197) and a ferritin nanoparticle subunit, wherein the HIV-1 Env fusion peptides are conjugated to the self-assembling protein nanoparticle carrier by linkers between lysine residues on the self-assembling protein nanoparticle carrier and a heterologous cysteine residue fused to a C-terminal residue of the HIV-1 Env fusion peptides.

In some embodiments, the immunogenic conjugate comprises any of the above HIV-1 Env fusion peptides (such as AVGIGAVF, residues 1-8 of SEQ ID NO: 1) conjugated to a self-assembling protein nanoparticle carrier formed from fusion proteins comprising a tetanus toxoid heavy chain C fragment and a lumazine synthase nanoparticle subunit and further comprising a heterologous T-cell helper epitope (such as AENLWVTVYYGVPVW (SEQ ID NO: 70) or TEKLWVTVYYGVPVW (SEQ ID NO: 71), wherein the HIV-1 Env fusion peptides are conjugated to the self-assembling protein nanoparticle carrier by linkers between lysine residues on the self-assembling protein nanoparticle carrier and a heterologous cysteine residue fused to a C-terminal residue of the HIV-1 Env fusion peptides.

In some embodiments, the immunogenic conjugate comprises any of the above HIV-1 Env fusion peptides (such as AVGIGAVF, residues 1-8 of SEQ ID NO: 1) conjugated to a self-assembling protein nanoparticle carrier formed from fusion proteins comprising *H. influenzae* protein D (HiD) and a lumazine synthase nanoparticle subunit and further comprising a heterologous T-cell helper epitope (such as AENLWVTVYYGVPVW (SEQ ID NO: 70) or TEKLWVTVYYGVPVW (SEQ ID NO: 71), wherein the HIV-1 Env fusion peptides are conjugated to the self-assembling protein nanoparticle carrier by linkers between lysine residues on the self-assembling protein nanoparticle carrier and a heterologous cysteine residue fused to a C-terminal residue of the HIV-1 Env fusion peptides.

In some embodiments, the immunogenic conjugate comprises any of the above HIV-1 Env fusion peptides (such as AVGIGAVF, residues 1-8 of SEQ ID NO: 1) conjugated to a self-assembling protein nanoparticle carrier formed from fusion proteins comprising diphtheria toxoid or a variant thereof (such as CRM197) and a lumazine synthase nanoparticle subunit and further comprising a heterologous T-cell helper epitope (such as AENLWVTVYYGVPVW (SEQ ID NO: 70) or TEKLWVTVYYGVPVW (SEQ ID NO: 71), wherein the HIV-1 Env fusion peptides are conjugated to the self-assembling protein nanoparticle carrier by linkers between lysine residues on the self-assembling protein nanoparticle carrier and a heterologous cysteine residue fused to a C-terminal residue of the HIV-1 Env fusion peptides.

In some embodiments, the immunogenic conjugate comprises any of the above HIV-1 Env fusion peptides (such as AVGIGAVF, residues 1-8 of SEQ ID NO: 1) conjugated to a self-assembling protein nanoparticle carrier formed from fusion proteins comprising a tetanus toxoid heavy chain C fragment and a ferritin nanoparticle subunit and further comprising a heterologous T-cell helper epitope (such as AENLWVTVYYGVPVW (SEQ ID NO: 70) or TEKLWVTVYYGVPVW (SEQ ID NO: 71), wherein the HIV-1 Env fusion peptides are conjugated to the self-assembling protein nanoparticle carrier by linkers between lysine residues on the self-assembling protein nanoparticle carrier and a heterologous cysteine residue fused to a C-terminal residue of the HIV-1 Env fusion peptides.

In some embodiments, the immunogenic conjugate comprises any of the above HIV-1 Env fusion peptides (such as AVGIGAVF, residues 1-8 of SEQ ID NO: 1) conjugated to a self-assembling protein nanoparticle carrier formed from fusion proteins comprising *H. influenzae* protein D (HiD) and a ferritin nanoparticle subunit and further comprising a heterologous T-cell helper epitope (such as AENLWVTVYYGVPVW (SEQ ID NO: 70) or TEKLWVTVYYGVPVW (SEQ ID NO: 71), wherein the HIV-1 Env fusion peptides are conjugated to the self-assembling protein nanoparticle carrier by linkers between lysine residues on the self-assembling protein nanoparticle carrier and a heterologous cysteine residue fused to a C-terminal residue of the HIV-1 Env fusion peptides.

In some embodiments, the immunogenic conjugate comprises any of the above HIV-1 Env fusion peptides (such as AVGIGAVF, residues 1-8 of SEQ ID NO: 1) conjugated to a self-assembling protein nanoparticle carrier formed from fusion proteins comprising diphtheria toxoid or a variant thereof (such as CRM197) and a ferritin nanoparticle subunit and further comprising a heterologous T-cell helper epitope (such as AENLWVTVYYGVPVW (SEQ ID NO: 70) or TEKLWVTVYYGVPVW (SEQ ID NO: 71), wherein the HIV-1 Env fusion peptides are conjugated to the self-assembling protein nanoparticle carrier by linkers between lysine residues on the self-assembling protein nanoparticle carrier and a heterologous cysteine residue fused to a C-terminal residue of the HIV-1 Env fusion peptides.

Typically, the HIV-1 Env fusion peptides are conjugated to the self-assembling protein nanoparticle carrier by a linker. Suitable linkers include, but are not limited to, straight or branched-chain carbon linkers, heterocyclic carbon linkers or peptide linkers. For an immunogenic conjugate from two or more constituents, each of the constituents will contain the necessary reactive groups. Representative combinations of such groups are amino with carboxyl to form amide linkages or carboxy with hydroxyl to form ester linkages or amino with alkyl halides to form alkylamino linkages or thiols with thiols to form disulfides or thiols with maleimides or alkylhalides to form thioethers. Hydroxyl, carboxyl, amino and other functionalities, where not present may be introduced by known methods. Likewise, a wide variety of linking groups may be employed. In some cases, the linking group can be designed to be either hydrophilic or hydrophobic in order to enhance the desired binding characteristics of the fusion peptide and the carrier. The covalent linkages should be stable relative to the solution conditions under which the conjugate is subjected.

In some embodiments, the linkers may be joined to the constituent amino acids through their side chains (such as through a disulfide linkage to cysteine) or to the alpha carbon, amino, and/or carboxyl groups of the terminal amino acids.

The procedure for attaching a molecule to a polypeptide varies according to the chemical structure of the molecule. Polypeptides typically contain a variety of functional groups; for example, carboxylic acid (COOH), free amine ($—NH_2$) or sulfhydryl (—SH) groups, which are available for reaction with a suitable functional group on a polypeptide. Alternatively, the polypeptide is derivatized to expose or attach additional reactive functional groups. The derivatization may involve attachment of any of a number of linker molecules such as those available from Pierce Chemical Company, Rockford, IL In some embodiments, a sulfosuccinimidyl (4-iodoacetyl) aminobenzoate (Sulfo-SIAB) linker is used to link the HIV-1 Env fusion peptides to the self-assembling protein nanoparticle carrier. In some embodiments an m-maleimidobenzoyl-N-hydroxysuccinimide ester (MBS) linker is used to link the HIV-1 Env fusion peptides to the self-assembling protein nanoparticle carrier.

The immunogenic conjugate includes a plurality of HIV-1 Env fusion peptides conjugated to the self-assembling protein nanoparticle carrier. In several embodiments, the conjugation of multiple HIV-1 Env fusion peptides to a single self-assembling protein nanoparticle carrier is possible because the carrier has multiple lysine or cysteine side-chains that can serve as sites of attachment. The amount of HIV-1 Env fusion peptide reacted with the amount of self-assembling protein nanoparticle carrier may vary depending upon the specific HIV-1 Env fusion peptide and the self-assembling protein nanoparticle carrier. The resulting number of HIV-1 Env fusion peptides linked to a single self-assembling protein nanoparticle carrier molecule may vary depending upon the specific HIV-1 Env fusion peptides and the self-assembling protein nanoparticle carrier.

Following conjugation of the HIV-1 Env fusion peptide to the protein nanoparticle carrier, the conjugate can be purified by appropriate techniques. One goal of the purification step is to separate the unconjugated HIV-1 Env fusion peptide or protein nanoparticle carrier from the conjugate. One method for purification, involving ultrafiltration in the presence of ammonium sulfate, is described in U.S. Pat. No. 6,146,902. Alternatively, the conjugates can be purified away from unconjugated HIV-1 Env fusion peptide or protein nanoparticle carrier by any number of standard techniques including, for example, size exclusion chromatography, density gradient centrifugation, hydrophobic interaction chromatography, or ammonium sulfate fractionation. See, for example, Anderson et al., *J. Immunol.* 137:1181-86, 1986 and Jennings & Lugowski, *J. Immunol.* 127:1011-18, 1981. The compositions and purity of the conjugates can be determined by GLC-MS and MALDI-TOF spectrometry, for example.

In several embodiments, the disclosed immunogenic conjugates can be formulated into immunogenic composition (such as vaccines), for example by the addition of a pharmaceutically acceptable carrier and/or adjuvant.

It is understood that some variations can be made in the amino acid sequence of a protein without affecting the activity of the protein. Such variations include insertion of amino acid residues, deletions of amino acid residues, and substitutions of amino acid residues. These variations in sequence can be naturally occurring variations or they can be engineered through the use of genetic engineering techniques. Examples of such techniques are found in see, e.g., Sambrook et al. (Molecular Cloning: A Laboratory Manual, $4^{th}$ ed, Cold Spring Harbor, New York, 2012) and Ausubel et al. (In Current Protocols in Molecular Biology, John Wiley & Sons, New York, through supplement 104, 2013, both of which are incorporated herein by reference in their entirety. Thus, the sequence of the fusion proteins of the disclosed self-assembling protein nanoparticle carrier can include modifications, such as amino acid substitutions, deletions or insertions, glycosylation and/or covalent linkage to unrelated proteins (e.g., a protein tag), as long as the fusion proteins self-assemble to form the self-assembling protein nanoparticle carrier.

III. NANOPARTICLES LINKED TO CARRIER BY ISOPEPTIDE BOND

Also provided herein are embodiments of a self-assembling nanoparticle-carrier protein where the nanoparticle is linked to carrier proteins by an isopeptide bond between a first tag on the subunits of the nanoparticle and a second tag on the carrier protein. In one example, the first and second tags are based on the *Streptococcus pyogenes* fibronectin binding protein Fbab-B, such as in the SpyTag/SpyCatcher fusion system. The sequence of *Streptococcus pyogenes* fibronectin binding protein Fbab-B is provided as follows:

```
                                              (SEQ ID NO: 398)
GAMVDTLSGLSSEQGQSGDMTIEEDSATHIKFSKRDIDGKELAGATMELR

DSSGKTISTWISDGQVKDFYLMPGKYTFVETAAPDGYEVATAITFTVNEQ

GQVTVNGKATKGDAHIVMVDAYKPTK
```

The final 13 residues of *Streptococcus pyogenes* fibronectin binding protein Fbab-B can be used as a first tag (the spytag) and the remaining residues of *Streptococcus pyogenes* fibronectin binding protein Fbab-B are the second tag (spycatcher). When mixed under appropriate conditions the two *Streptococcus pyogenes* fibronectin binding protein Fbab-B segments bind and form a covalent isopeptide bond.

Any of the nanoparticle subunits disclosed herein can be linked to any of the carrier proteins disclosed herein using the spytag/spycatcher (or other suitable isopeptide bond tag) to generate a nanoparticle-carrier protein to which one or more vaccine antigens (such as an HIV-1 Env fusion peptide as disclosed herein) can be conjugated. In several embodiments, the spytag/spycatcher (or other suitable isopeptide bond tag) is substituted for the peptide linker separating the nanoparticle subunit and carrier protein.

In some embodiments, a lumazine synthase subunit is fused to a spytag and combined with any of the carrier proteins described herein that has been fused to a corresponding spycatcher tag. Non-limiting examples of lumazine synthase subunits fused to a spytag for use in the disclosed embodiments, include:

LS-SpyTag
(SEQ ID NO: 399)
AHIVMVDAYKPTKgsgsaMQIYEGKLTAEGLRFGIVASRFNHALVDRLVE
GAIDAIVRHGGREEDITLVRVPGSWEIPVAAGELARKEnIsAVIAIGVLI
RGATPHFDYIASEVSKGLADLSLELRKPITFGVITADTLEQAIERAGTKH
GNKGWEAALSAIEMANLFKSLR LS-SpyTag LODS3 (single Cysteine?)
(SEQ ID NO: 400)
AHIVMVDAYKPTKgsgsaMQIYEGKLTAEGLRFGIVASRFNHALVDRLVE
GcIDAIVRHGGREEDITLVRVPGSWEIPVAAGELARKEnIsAVIAIGVLI
RGATPHFDYIASEVSKGLADLSLELRKPITFGVITADTLEQAIERAGTKH
GNKGWEAALSAIEMANLFKSLR LS-SpyTag LODS5 (intra-protomer)
(SEQ ID NO: 401)
AHIVMVDAYKPTKgsgsaMQIYEGKLTAEGLRFGIVASRFNHALVDRLVE
GAIDAIVRHGGREEDITLVRVPGSWEIPVAAGELARKEnIsAVIAIGVLI
RGATPHFDYIASEVSKGLADLSLELRKPIcFGVITADTLEQAIERAGTKH
GNKGWEAALcAIEMANLFKSLR LS-SpyTag DS2-49
(SEQ ID NO: 402)
AHIVMVDAYKPTKgsgsaMcIYEGKLTAEGLRFGIVASRFNHALVDRLVE
GAIDAIVRHGGREEDIcLVRVPGSWEIPVAAGELARKEnIsAVIAIGVLI
RGATPHFDYIASEVSKGLADLSLELRKPITFGVITADTLEQAIERAGTKH
GNKGWEAALSAIEMANLFKSLR LS-SpyTag DS54-142
(SEQ ID NO: 403)
AHIVMVDAYKPTKgsgsaMQIYEGKLTAEGLRFGIVASRFNHALVDRLVE
GAIDAIVRHGGREEDITLVRVcGSWEIPVAAGELARKEnIsAVIAIGVLI
RGATPHFDYIASEVSKGLADLSLELRKPITFGVITADTLEQAIERAGTKH
GNKGWEAALcAIEMANLFKSLR LS-SpyTag D595-101
(SEQ ID NO: 404)
AHIVMVDAYKPTKgsgsaMQIYEGKLTAEGLRFGIVASRFNHALVDRLVE
GAIDAIVRHGGREEDITLVRVPGSWEIPVAAGELARKEnIsAVIAIGVLI
RGATPHFDYIAScVSKGLcDLSLELRKPITFGVITADTLEQAIERAGTKH
GNKGWEAALSAIEMANLFKSLR In some embodiments, a ferritin subunit is fused to a spytag and combined with any of the carrier proteins described herein that has been fused to a corresponding spycatcher tag. Non-limiting examples of ferritin subunits fused to a spytag for use in the disclosed embodiments, include:

Ferr 96N SpyTag N-2-THS
(SEQ ID NO: 405)
AHIVMVDAYKPTKgggsgDPMLSKDIIKLLNEQVNKEMQSSNLYMSMSSW
CYTHSLDGAGLFLFDHAAEEYEHAKKLIIFLNENNVPVQLTSISAPEHKF
EGLTQIFQKAYEHEQnISESINNIVDHAIKSKDHATFNFLQWYVAEQHEE
EVLFKDILDKIELIGNENHGLYLADQYVKGIAKSRKS Ferr 148S SpyTag N5-THS
(SEQ ID NO: 406)
AHIVMVDAYKPTKgggsgDIIKLLNEQVNKEMQSSNLYMSMSSWCYTHSL
DGAGLFLFDHAAEEYEHAKKLIIFLNENNVPVQLTSISAPEHKFEGLTQI
FQKAYEHEQHISESINNIVDHAIKSKDHATFNFLQWYVAEQHEEEVLFKD
ILDKIELIGNEsHGLYLADQYVKGIAKSRKS In some embodiments, an encapsulin subunit is fused to a spytag and combined with any of the carrier proteins described herein that has been fused to a corresponding spycatcher tag. A non-limiting examples of an encapsulin subunit fused to a spytag for use in the disclosed embodiments, includes:

EN G53C-R94C - spytag
(SEQ ID NO: 410)
MEFLKRSFAPLTEKQWQEIDNRAREIFKTQLYGRKFVDVEGPYGWEYAAH
PLCEVEVLSDENEVVKWGLRKSLPLIELRATFTLDLWELDNLECGKPNVD
LSSLEETVRKVAEFEDEVIFRGCEKSGVKGLLSFEERKIECGSTPKDLLE
AIVRALSIFSKDGIEGPYTLVINTDRWINFLKEEAGHYPLEKRVEECLRG
GKIITTPRIEDALVVSERGGDFKLILGQDLSIGYEDREKDAVRLFITETF
TFQVVNPEALILLKFgggsgAHIVMVDAYKPTK The spycatcher tag can be genetically fused to any of carrier proteins provided herein for subsequent isopeptide bond linkage to a nanoparticle subunit fused to a corresponding spytag. In some embodiments, a peptide linker is included between the carrier protein and spycatcher tag or between the nanoparticle subunit and spytag. In one example, the rTT carrier protein fused to the spycatcher tag comprises an amino acid sequence set forth as:

(SEQ ID NO: 407)
MKNLDCWVDNEEDIDVILKKSTILNLDINNDIISDISGFNSSVITYPDAQ
LVPGINGKAIHLVNNESSEVIVHKAMDIEYNDMFNNFTVSFWLRVPKVSA
SHLEQYGTNEYSIISSMKKHSLSIGSGWSVSLKGNNLIWTLKDSAGEVRQ
ITFRDLPDKFNAYLANKWVFITITNDRLSSANLYINGVLMGSAEITGLGA
IREDNNITLKLDRCNNNNQYVSIDKFRIFCKALNPKEIEKLYTSYLSITF
LRDFWGNPLRYDTEYYLIPVASSSKDVQLKNITDYMYLTNAPSYTNGKLN
IYYRRLYNGLKFIIKRYTPNNEIDSFVKSGDFIKLYVSYNNNEHIVGYPK
DGNAFNNLDRILRVGYNAPGIPLYKKMEAVKLRDLKTYSVQLKLYDDKNA
SLGLVGTHNGQIGNDPNRDILIASNWYFNHLKDKILGCDWYFVPTDEGWT
NDgsgDSATHIKFSKRDEDGKELAGATMELRDSSGKTISTWISDGQVKDF
YLYPGKYTFVETAAPDGYEVATAITFTVNEQGQVTVNGKATKGDAHI In one example, the spytag (e.g., AHIVMVDAYKPTK, SEQ ID NO: 408) is genetically fused to the self-assembling protein nanoparticle subunit, and the nanoparticle with spytag is produced under standard conditions. The spycatcher tag (e.g., DSATHIKFSKRDEDGKELAGAT-MELRDSSGKTISTWISDGQVKDFY-LYPGKYTFVETAAPDGYEVA TAITFTV-NEQGQVTVNGKATKGDAHI, SEQ ID NO: 409) is genetically fused to the carrier protein (e.g., rTT), and the carrier protein with spycatcher is produced under standard conditions. The nanoparticle/spytag and carrier/spycatcher are subsequently mixed under conditions sufficient for the spycatcher/spytag to form an isopeptide bond and covalently link the nanoparticle and carrier proteins. The resulting nanoparticle carrier can be used immediately or stored for subsequent conjugation to one or more vaccine antigens of interest.

IV. SELF-ASSEMBLING PROTEIN NANOPARTICLES

Additionally provided herein are novel self-assembling protein nanoparticles and subunits thereof. In some embodiments, the self-assembling protein nanoparticle subunit comprises or consists of any one of the self-assembling protein nanoparticle subunit discussed above in Section II.A.1 for fusion with a heterologous carrier and generation of an immunogenic conjugate.

In some embodiments, the self-assembling protein nanoparticle subunit is a lumazine synthase nanoparticle subunit comprising cysteine substitutions to introduce one or more non-native disulfide bonds to increase stability of the nanoparticle, wherein the cysteine substitutions comprise 121C and 131C substitutions, 121CG and 131C substitutions, 121GC and 131C substitutions, 7C and 40C substitutions, 3C and 50C substitutions, 82C and 131CG substitutions, 5C and 52C substitutions, or 95C and A101C substitutions, or a combination thereof, wherein residue numbering corresponds to a reference lumazine synthase subunit set forth as SEQ ID NO: 25. In some embodiments, the self-assembling protein nanoparticle subunit is a lumazine synthase nanoparticle subunit comprising or consisting of the amino acid sequence set forth as any one of SEQ ID NOs: 306-312, or an amino acid sequence at least 90% (such as at least 95%, at least 98%, or at least 99%) identical thereto.

In some embodiments, the self-assembling protein nanoparticle subunit is an encapsulin nanoparticle subunit comprising cysteine substitutions to introduce one or more non-native disulfide bonds to increase stability of the nanoparticle, wherein the cysteine substitutions comprise 53C and 94C substitutions, 53C and 96C substitutions, or 146C and 185C substitutions, or a combination thereof, wherein residue numbering corresponds to a reference lumazine synthase subunit set forth as SEQ ID NO: 43. In some embodiments, the self-assembling protein nanoparticle subunit is an encapsulin nanoparticle subunit comprising or consisting of the amino acid sequence set forth as any one of SEQ ID NOs: 313-315, or an amino acid sequence at least 90% (such as at least 95%, at least 98%, or at least 99%) identical thereto.

In some embodiments, the self-assembling protein nanoparticle subunit is an *Acinetobacter* phage AP205 nanoparticle subunit comprising cysteine substitutions to introduce one or more non-native disulfide bonds to increase stability of the nanoparticle, wherein the cysteine substitutions comprise a T81C substitution, 53C and 100C substitution, or 82C and 80C substitutions, or a combination thereof, wherein residue numbering corresponds to a reference lumazine synthase subunit set forth as SEQ ID NO: 316. In some embodiments, the self-assembling protein nanoparticle subunit is a *Acinetobacter* phage AP205 protein subunit comprising or consisting of the amino acid sequence set forth as any one of SEQ ID NOs: 317-320, or an amino acid sequence at least 90% (such as at least 95%, at least 98%, or at least 99%) identical thereto; or In some embodiments, the self-assembling protein nanoparticle subunit is a Hepatitis B capsid protein nanoparticle subunit comprising cysteine substitutions to introduce one or more non-native disulfide bonds to increase stability of the nanoparticle, wherein the cysteine substitutions comprise 25C and 127C substitutions, 14C and 36C substations, 29C and 127C substitutions, 18C and 36C substitutions, or 29C and 127C substitutions, or a combination thereof, wherein residue numbering corresponds to a reference lumazine synthase subunit set forth as SEQ ID NO: 321. In some embodiments, the self-assembling protein nanoparticle subunit is a Hepatitis B capsid protein subunit comprising or consisting of the amino acid sequence set forth as any one of SEQ ID NOs: 322-326, or an amino acid sequence at least 90% (such as at least 95%, at least 98%, or at least 99%) identical thereto.

In some embodiments, the self-assembling protein nanoparticle subunit is a ferritin nanoparticle subunit comprising or consisting of the amino acid sequence set forth as any one of SEQ ID NOs: 258-305, or an amino acid sequence at least 90% (such as at least 95%, at least 98%, or at least 99%) identical thereto.

In some embodiments, the recombinant self-assembling nanoparticle subunit is fused to a heterologous carrier protein, such as any of the heterologous carrier proteins discussed above in Section II.A.2 for fusion with a self-assembling protein nanoparticle subunit and generation of an immunogenic conjugate. In some embodiments, the recombinant self-assembling nanoparticle subunit is fused to a tetanus toxin heavy chain C fragment, a diphtheria toxin variant CRM197, and an *H. influenzae* protein D, a Keyhole Limpet Hemocyanin (KLH) functional unit, a Meningococcal outer membrane protein complex protein, an Outer-membrane lipoprotein carrier protein, or a Cholera toxin B subunit. Fusion of the heterologous cattier protein to the recombinant self-assembling nanoparticle subunit can be direct (e.g., vis peptide bond between the nanoparticle subunit and the carrier) or indirect via a peptide linker. Any suitable peptide linker may be used, such as the linkers discussed above discussed above in Section II.A.3 for fusion with a self-assembling protein nanoparticle subunit and generation of an immunogenic conjugate.

Also provided are self-assembled protein nanoparticles formed from the nanoparticle subunits. If the nanoparticle subunit is fused to a heterologous carrier protein, then the self-assembled protein nanoparticle will include multiple copies of the heterologous carrier.

In further embodiments, the self-assembled protein nanoparticle is conjugated to a vaccine antigen.

V. POLYNUCLEOTIDES AND EXPRESSION

Polynucleotides encoding a disclosed fusion protein that forms a self-assembling protein nanoparticle carrier or self-assembling protein nanoparticle are also provided. These polynucleotides include DNA, cDNA and RNA sequences which encode the fusion protein. The genetic code can be used to construct a variety of functionally equivalent nucleic acids, such as nucleic acids which differ in sequence but which encode the same protein sequence, or encode a conjugate or fusion protein including the nucleic acid sequence.

In several embodiments, the nucleic acid molecule encodes a precursor of a disclosed fusion protein and/or nanoparticle subunit, that, when expressed in cells under appropriate conditions, is processed and self-assembles into the protein nanoparticle carrier or protein nanoparticle. For example, the nucleic acid molecule can encode a N-terminal signal sequence for entry into the cellular secretory system that is proteolytically cleaved in the during processing of the fusion protein.

Exemplary nucleic acids can be prepared by cloning techniques. Examples of appropriate cloning and sequencing techniques, and instructions sufficient to direct persons of skill through many cloning exercises are known (see, e.g., Sambrook et al. (Molecular Cloning: A Laboratory Manual, 4$^{th}$ ed, Cold Spring Harbor, New York, 2012) and Ausubel et al. (In Current Protocols in Molecular Biology, John Wiley & Sons, New York, through supplement 104, 2013).

Nucleic acids can also be prepared by amplification methods. Amplification methods include polymerase chain reaction (PCR), the ligase chain reaction (LCR), the transcription-based amplification system (TAS), the self-sustained sequence replication system (3SR). A wide variety of cloning methods, host cells, and in vitro amplification methodologies are well known to persons of skill.

The polynucleotides encoding a disclosed fusion protein and/or nanoparticle subunit can include a recombinant DNA which is incorporated into a vector into an autonomously replicating plasmid or virus or into the genomic DNA of a prokaryote or eukaryote, or which exists as a separate molecule (such as a cDNA) independent of other sequences. The nucleotides can be ribonucleotides, deoxyribonucleotides, or modified forms of either nucleotide. The term includes single and double forms of DNA.

Polynucleotide sequences encoding a disclosed fusion protein and/or nanoparticle subunit can be operatively linked to expression control sequences. An expression control sequence operatively linked to a coding sequence is ligated such that expression of the coding sequence is achieved under conditions compatible with the expression control sequences. The expression control sequences include, but are not limited to, appropriate promoters, enhancers, transcription terminators, a start codon (i.e., ATG) in front of a protein-encoding gene, splicing signals for introns, maintenance of the correct reading frame of that gene to permit proper translation of mRNA, and stop codons.

DNA sequences encoding the disclosed fusion protein and/or nanoparticle subunit can be expressed in vitro by DNA transfer into a suitable host cell. The cell may be prokaryotic or eukaryotic. The term also includes any progeny of the subject host cell. It is understood that all progeny may not be identical to the parental cell since there may be mutations that occur during replication. Methods of stable transfer, meaning that the foreign DNA is continuously maintained in the host, are known in the art.

Hosts can include microbial, yeast, insect and mammalian organisms. Methods of expressing DNA sequences having eukaryotic or viral sequences in prokaryotes are well known in the art. Non-limiting examples of suitable host cells include bacteria, archea, insect, fungi (for example, yeast), plant, and animal cells (for example, mammalian cells, such as human). Exemplary cells of use include *Escherichia coli, Bacillus subtilis, Saccharomyces cerevisiae, Salmonella typhimurium*, SF9 cells, C129 cells, 293 cells, *Neurospora*, and immortalized mammalian myeloid and lymphoid cell lines. Techniques for the propagation of mammalian cells in culture are well-known (see, e.g., Helgason and Miller (Eds.), 2012, Basic Cell Culture Protocols (Methods in Molecular Biology), 4$^{th}$ Ed., Humana Press). Examples of commonly used mammalian host cell lines are VERO and HeLa cells, CHO cells, and WI38, BHK, and COS cell lines, although cell lines may be used, such as cells designed to provide higher expression, desirable glycosylation patterns, or other features. In some embodiments, the host cells include HEK293 cells or derivatives thereof, such as GnTI$^{-/-}$ cells (ATCC® No. CRL-3022), or HEK-293F cells.

Transformation of a host cell with recombinant DNA can be carried out by conventional techniques. In some embodiments, if the host is prokaryotic, such as, but not limited to, *E. coli*, competent cells which are capable of DNA uptake can be prepared from cells harvested after exponential growth phase and subsequently treated by the CaCl$_2$ method. Alternatively, MgCl$_2$ or RbCl can be used. Transformation can also be performed after forming a protoplast of the host cell if desired, or by electroporation.

When the host is a eukaryote, such methods of transfection of DNA as calcium phosphate coprecipitates, conventional mechanical procedures such as microinjection, electroporation, insertion of a plasmid encased in liposomes, or viral vectors can be used. Eukaryotic cells can also be co-transformed with polynucleotide sequences encoding a disclosed antigen, and a second foreign DNA molecule encoding a selectable phenotype, such as the herpes simplex thymidine kinase gene. Another method is to use a eukaryotic viral vector, such as simian virus 40 (SV40) or bovine papilloma virus, to transiently infect or transform eukaryotic cells and express the protein (see for example, Viral Expression Vectors, Springer press, Muzyczka ed., 2011). Appropriate expression systems such as plasmids and vectors of use in producing proteins in cells including higher eukaryotic cells such as the COS, CHO, HeLa and myeloma cell lines can be utilized.

Modifications can be made to a nucleic acid encoding a disclosed fusion protein and/or nanoparticle subunit without diminishing its biological activity. Some modifications can be made to facilitate the cloning or expression of the fusion protein. Non-limiting examples of such modifications include termination codons, a methionine added at the amino terminus to provide an initiation site, additional amino acids placed on either terminus to create conveniently located restriction sites, or additional amino acids (such as poly His) to aid in purification steps.

VI. IMMUNOGENIC COMPOSITIONS

Immunogenic compositions comprising a disclosed immunogenic conjugate and a pharmaceutically acceptable carrier are also provided. Such pharmaceutical compositions can be administered to subjects by a variety of administration modes, for example, intramuscular, subcutaneous, intravenous, intra-arterial, intra-articular, intraperitoneal, or parenteral routes. IActual methods for preparing administrable compositions are described in more detail in such publications as *Remingtons Pharmaceutical Sciences*, 19$^{th}$ Ed., Mack Publishing Company, Easton, Pennsylvania, 1995.

Thus, an immunogenic conjugate described herein can be formulated with pharmaceutically acceptable carriers to help retain biological activity while also promoting increased stability during storage within an acceptable temperature range. Potential carriers include, but are not limited to, physiologically balanced culture medium, phosphate buffer saline solution, water, emulsions (e.g., oil/water or water/oil emulsions), various types of wetting agents, cryoprotective additives or stabilizers such as proteins, peptides or hydrolysates (e.g., albumin, gelatin), sugars (e.g., sucrose, lactose, sorbitol), amino acids (e.g., sodium glutamate), or other protective agents. The resulting aqueous solutions may be packaged for use as is or lyophilized Lyophilized preparations are combined with a sterile solution prior to administration for either single or multiple dosing.

Formulated compositions, especially liquid formulations, may contain a bacteriostat to prevent or minimize degradation during storage, including but not limited to effective concentrations (usually ≤1% w/v) of benzyl alcohol, phenol, m-cresol, chlorobutanol, methylparaben, and/or propylparaben. A bacteriostat may be contraindicated for some patients; therefore, a lyophilized formulation may be reconstituted in a solution either containing or not containing such a component.

The immunogenic compositions of the disclosure can contain as pharmaceutically acceptable vehicles substances as required to approximate physiological conditions, such as pH adjusting and buffering agents, tonicity adjusting agents, wetting agents and the like, for example, sodium acetate, sodium lactate, sodium chloride, potassium chloride, calcium chloride, sorbitan monolaurate, and triethanolamine oleate.

The immunogenic composition may optionally include an adjuvant to enhance an immune response of the host. Suitable adjuvants are, for example, toll-like receptor agonists, alum, AlPO4, alhydrogel, Lipid-A and derivatives or variants thereof, oil-emulsions, saponins, neutral liposomes, liposomes containing the vaccine and cytokines, non-ionic block copolymers, and chemokines. Non-ionic block polymers containing polyoxyethylene (POE) and polyxylpropylene (POP), such as POE-POP-POE block copolymers, MPL™ (3-O-deacylated monophosphoryl lipid A; Corixa, Hamilton, IN) and IL-12 (Genetics Institute, Cambridge, MA) may also be used as an adjuvant (Newman et al., 1998, *Critical Reviews in Therapeutic Drug Carrier Systems* 15:89-142). These adjuvants have the advantage in that they help to stimulate the immune system in a non-specific way, thus enhancing the immune response to a pharmaceutical product.

In some embodiments, the immunogenic composition can be provided as a sterile composition. The immunogenic composition typically contains an effective amount of a disclosed immunogenic conjugate and can be prepared by conventional techniques. Typically, the amount of immunogenic conjugate in each dose of the immunogenic composition is selected as an amount which elicits or primes an immune response without significant, adverse side effects. In some embodiments, the immunogenic composition can be provided in unit dosage form for use to elicit or prime an immune response in a subject, for example, to prevent HIV-1 infection in the subject. A unit dosage form contains a suitable single preselected dosage for administration to a subject, or suitable marked or measured multiples of two or more preselected unit dosages, and/or a metering mechanism for administering the unit dose or multiples thereof.

VII. METHODS OF INDUCING AN IMMUNE RESPONSE

The disclosed immunogenic conjugates and compositions including same can be administered to a subject to induce an immune response to HIV-1 to prevent, inhibit, and/or treat an HIV-1 infection. The immune response can be a protective immune response, for example a response that prevents or reduces subsequent infection with HIV-1. Elicitation of the immune response can also be used to treat or inhibit infection and illnesses associated with HIV-1 infection. Thus, the disclosed immunogenic conjugates and compositions including same can be used in methods of preventing, inhibiting, or treating an HIV-1 infection. In several embodiments, an effective amount of an immunogenic conjugate or composition including same can be administered to a subject in order to generate a neutralizing immune response to HIV-1.

When inhibiting, treating, or preventing HIV-1 infection, the methods can be used either to avoid infection in an HIV-1 seronegative subject (e.g., by inducing an immune response that protects against HIV-1 infection), or to treat existing infection in an HIV-1 seropositive subject. The HIV-1 seropositive subject may or may not carry a diagnosis of AIDS. Hence in some embodiments the methods involve selecting a subject at risk for contracting HIV-1 infection, or a subject at risk of developing AIDS (such as a subject with HIV-1 infection), and administering a disclosed immunogenic conjugate or composition including same to the subject to elicit an immune response to HIV-1 in the subject.

Treatment of HIV-1 by inhibiting HIV-1 replication or infection can include delaying the development of AIDS in a subject. Treatment of HIV-1 can also include reducing signs or symptoms associated with the presence of HIV-1 (for example, by reducing or inhibiting HIV-1 replication). In some examples, treatment using the methods disclosed herein prolongs the time of survival of the subject.

Typical subjects intended for treatment with the therapeutics and methods of the present disclosure include humans, as well as non-human primates and other animals. To identify subjects for prophylaxis or treatment according to the methods of the disclosure, accepted screening methods are employed to determine risk factors associated with a targeted or suspected disease or condition, or to determine the status of an existing disease or condition in a subject. These screening methods include, for example, conventional work-ups to determine environmental, familial, occupational, and other such risk factors that may be associated with the targeted or suspected disease or condition, as well as diagnostic methods, such as various ELISA and other immunoassay methods to detect and/or characterize HIV-1 infection. These and other routine methods allow the clinician to select patients in need of therapy using the methods and pharmaceutical compositions of the disclosure.

The disclosed immunogenic conjugates and compositions including same can be used in coordinate (or prime-boost) immunization protocols or combinatorial formulations. In certain embodiments, novel combinatorial immunogenic compositions and coordinate immunization protocols employ separate immunogenic conjugate or formulations, each directed toward eliciting an anti-HIV-1 immune response, such as an immune response to HIV-1 Env protein. Separate immunogenic conjugates and compositions including same that elicit the anti-HIV-1 immune response can be combined in a polyvalent immunogenic composition administered to a subject in a single immunization step, or they can be administered separately (in monovalent immunogenic compositions) in a coordinate immunization protocol.

In one embodiment, a suitable immunization regimen includes at least two separate inoculations with one or more immunogenic compositions including a disclosed immunogen, with a second inoculation being administered more than about two, about three to eight, or about four, weeks following the first inoculation. A third inoculation can be administered several months after the second inoculation, and in specific embodiments, more than about five months after the first inoculation, more than about six months to about two years after the first inoculation, or about eight months to about one year after the first inoculation. Periodic inoculations beyond the third are also desirable to enhance the subject's "immune memory." The adequacy of the immunization parameters chosen, e.g., formulation, dose, regimen and the like, can be determined by taking aliquots of serum from the subject and assaying antibody titers during the course of the immunization program. Alternatively, the T cell populations can be monitored by conventional methods. In addition, the clinical condition of the subject can be monitored for the desired effect, e.g., prevention of HIV-1 infection or progression to AIDS, improvement in disease state (e.g., reduction in viral load), or reduction in transmission frequency to an uninfected partner. If such monitoring indicates that immunization is suboptimal, the subject can be boosted with an additional dose of immunogenic composition, and the immunization parameters can be modified in a fashion expected to potentiate the immune response.

It is contemplated that there can be several boosts, and that each boost can be a different HIV-1 immunogen. It is also contemplated in some examples that the boost may be the same immunogen as another boost, or the prime.

In some embodiments, the prime comprises administration of an immunogenic conjugate as described herein, and the boost (or boosts) comprises administration a recombinant HIV-1 Env ectodomain trimer that is stabilized in a prefusion mature closed conformation, for example, as described in PCT App. No. PCT/US2015/048729 (incorporated by reference herein in its entirety).

The prime and the boost can be administered as a single dose or multiple doses, for example, two doses, three doses, four doses, five doses, six doses or more can be administered to a subject over days, weeks or months. Multiple boosts can also be given, such one to five, or more. Different dosages can be used in a series of sequential inoculations. For example, a relatively large dose in a primary inoculation and then a boost with relatively smaller doses. The immune response against the selected antigenic surface can be generated by one or more inoculations of a subject.

In several embodiments, the immunogenic conjugate can be administered to the subject simultaneously with the administration of an adjuvant. In other embodiments, the immunogenic conjugate can be administered to the subject after the administration of an adjuvant and within a sufficient amount of time to elicit the immune response.

Determination of effective dosages in this context is typically based on animal model studies followed up by human clinical trials and is guided by administration protocols that significantly reduce the occurrence or severity of targeted disease symptoms or conditions in the subject, or that elicit a desired response in the subject (such as a neutralizing immune response). Suitable models in this regard include, for example, murine, rat, porcine, feline, ferret, non-human primate. Alternatively, effective dosages can be determined using in vitro models (for example, immunologic and histopathologic assays). Using such models, ordinary calculations and adjustments can be used to determine an appropriate concentration and dose to administer an effective amount of the composition (for example, amounts that are effective to elicit a desired immune response or alleviate one or more symptoms of a targeted disease). In alternative embodiments, an effective amount or effective dose of the immunogenic conjugate may simply inhibit or enhance one or more selected biological activities correlated with a disease or condition, as set forth herein, for either therapeutic or diagnostic purposes.

Dosage can be varied by the attending clinician to maintain a desired concentration at a target site. Higher or lower concentrations can be selected based on the mode of delivery, for example, trans-epidermal, rectal, oral, pulmonary, or intranasal delivery versus intravenous or subcutaneous delivery. The actual dosage of disclosed immunogenic conjugate will vary according to factors such as the disease indication and particular status of the subject (for example, the subject's age, size, fitness, extent of symptoms, susceptibility factors, and the like), time and route of administration, other drugs or treatments being administered concurrently, as well as the specific pharmacology of the composition for eliciting the desired activity or biological response in the subject. Dosage regimens can be adjusted to provide an optimum prophylactic or therapeutic response.

A non-limiting range for an effective amount of the disclosed immunogenic conjugate within the methods and immunogenic compositions of the disclosure is about 0.0001 mg/kg body weight to about 10 mg/kg body weight, such as about 0.01 mg/kg, about 0.02 mg/kg, about 0.03 mg/kg, about 0.04 mg/kg, about 0.05 mg/kg, about 0.06 mg/kg, about 0.07 mg/kg, about 0.08 mg/kg, about 0.09 mg/kg, about 0.1 mg/kg, about 0.2 mg/kg, about 0.3 mg/kg, about 0.4 mg/kg, about 0.5 mg/kg, about 0.6 mg/kg, about 0.7 mg/kg, about 0.8 mg/kg, about 0.9 mg/kg, about 1 mg/kg, about 1.5 mg/kg, about 2 mg/kg, about 2.5 mg/kg, about 3 mg/kg, about 4 mg/kg, about 5 mg/kg, or about 10 mg/kg, for example, 0.01 mg/kg to about 1 mg/kg body weight, about 0.05 mg/kg to about 5 mg/kg body weight, about 0.2 mg/kg to about 2 mg/kg body weight, or about 1.0 mg/kg to about 10 mg/kg body weight. In some embodiments, the dosage includes a set amount of a disclosed immunogenic conjugate such as from about 1-300 µg, for example, a dosage of about 1, 2, 3, 4, 5, 6, 7, 8, 9, 10, 15, 20, 30, 40, 50, 60, 70, 80, 90, 100, 150, 200, 250, or about 300 µg.

The dosage and number of doses will depend on the setting, for example, in an adult or anyone primed by prior HIV-1 infection or immunization, a single dose may be a sufficient booster. In naïve subjects, in some examples, at least two doses would be given, for example, at least three doses. In some embodiments, an annual boost is given, for example, along with an annual influenza vaccination.

For any application, immunization with a disclosed immunogenic conjugate can be combined with anti-retroviral therapy, such as HAART. Antiretroviral drugs are broadly classified by the phase of the retrovirus life-cycle that the drug inhibits. The therapeutic agents can be administered before, during, concurrent to and/or after retroviral therapy. In some embodiments, the therapeutic agents are administered following a course of retroviral therapy. The disclosed therapeutic agents can be administered in conjunction with nucleoside and nucleotide reverse transcriptase inhibitors (nRTI), non-nucleoside reverse transcriptase inhibitors (NNRTI), protease inhibitors, Entry inhibitors (or fusion inhibitors), Maturation inhibitors, or a broad spectrum inhibitors, such as natural antivirals. Exemplary agents include lopinavir, ritonavir, zidovudine, lamivudine, tenofovir, emtricitabine and efavirenz.

HIV-1 infection does not need to be completely eliminated or reduced or prevented for the methods to be effective. For example, elicitation of an immune response to HIV-1 with one or more of the disclosed immunogenic conjugates (or an immunization protocol involving a disclosed immunogenic conjugate) can reduce or inhibit HIV-1 infection by a desired amount, for example, by at least 10%, at least 20%, at least 50%, at least 60%, at least 70%, at least 80%, at least 90%, at least 95%, at least 98%, or even at least 100% (elimination or prevention of detectable HIV-1 infected cells), as compared to HIV-1 infection in the absence of the therapeutic agent. In additional examples, HIV-1 replication can be reduced or inhibited by the disclosed methods. HIV-1 replication does not need to be completely eliminated for the method to be effective. For example, the immune response elicited using one or more of the disclosed immunogens can reduce HIV-1 replication by a desired amount, for example, by at least 10%, at least 20%, at least 50%, at least 60%, at least 70%, at least 80%, at least 90%, at least 95%, at least 98%, or even at least 100% (elimination or prevention of detectable HIV-1 replication), as compared to HIV-1 replication in the absence of the immune response.

To successfully reproduce itself, HIV-1 must convert its RNA genome to DNA, which is then imported into the host cell's nucleus and inserted into the host genome through the action of HIV-1 integrase. Because HIV-1's primary cellular target, CD4+ T-Cells, can function as the memory cells of the immune system, integrated HIV-1 can remain dormant for the duration of these cells' lifetime. Memory T-Cells may survive for many years and possibly for decades. This latent HIV-1 reservoir can be measured by co-culturing CD4+ T-cells from infected patients with CD4+ T-Cells from uninfected donors and measuring HIV-1 protein or RNA (See, e.g., Archin et al., *AIDS,* 22:1131-1135, 2008). In some embodiments, the provided methods induce an immune response in the subject that reduces or eliminates of the latent reservoir of HIV-1 infected cells in a subject. For example, a reduction of at least 10%, at least 20%, at least 50%, at least 60%, at least 70%, at least 80%, at least 90%, at least 95%, at least 98%, or even at least 100% (elimination of detectable HIV-1) of the latent reservoir of HIV-1 infected cells in a subject, as compared to the latent reservoir of HIV-1 infected cells in a subject in the absence of immunization with one or more of the provided immunogenic conjugates.

Following immunization of a subject, serum can be collected from the subject at appropriate time points, frozen, and stored for neutralization testing. Methods to assay for neutralization activity and include, but are not limited to, plaque reduction neutralization (PRNT) assays, microneutralization assays, flow cytometry based assays, single-cycle infection assays (e.g., as described in Martin et al. (2003) *Nature Biotechnology* 21:71-76), and pseudovirus neutralization assays (e.g., as described in Georgiev et al. (Science, 340, 751-756, 2013), Seaman et al. (J. Virol., 84, 1439-1452, 2005), and Mascola et al. (J. Virol., 79, 10103-10107, 2005), each of which is incorporated by reference herein in its entirety. In some embodiments, the serum neutralization activity can be assayed using a panel of HIV-1 pseudoviruses as described in Georgiev et al., Science, 340, 751-756, 2013 or Seaman et al. J. Virol., 84, 1439-1452, 2005. Briefly, pseudovirus stocks are prepared by co-transfection of 293T cells with an HIV-1 Env-deficient backbone and an expression plasmid encoding the Env gene of interest. The serum to be assayed is diluted in Dulbecco's modified Eagle medium-10% FCS (Gibco) and mixed with pseudovirus. After 30 min, 10,000 TZM-bl cells are added, and the plates are incubated for 48 hours. Assays are developed with a luciferase assay system (Promega, Madison, WI), and the relative light units (RLU) are read on a luminometer (Perkin-Elmer, Waltham, MA). To account for background, a cutoff of $ID_{50} \geq 40$ can be used as a criterion for the presence of serum neutralization activity against a given pseudovirus.

In some embodiments, administration of an effective amount of one or more of the disclosed the immunogenic conjugates to a subject elicits a neutralizing immune response in the subject, wherein serum from the subject neutralizes, with an $ID_{50} \geq 40$, at least 10% (such as at least 15%, at least 20%, at least 30%, at least 40%, at least 50%, or at least 70%) of pseudoviruses is a panel of pseudoviruses including the HIV-1 Env proteins listed in Table S5 or Table S6 of Georgiev et al. (Science, 340, 751-756, 2013), or Table 1 of Seaman et al. (J. Virol., 84, 1439-1452, 2005).

EXAMPLES

The following examples are provided to illustrate particular features of certain embodiments, but the scope of the claims should not be limited to those features exemplified.

Example 1

Immunogenic Conjugate of HIV-1 Env Fusion Peptides Conjugated to a Self-Assembling Protein Nanoparticle Carrier This example illustrates immunogenic conjugates including HIV-1 Env fusion peptides conjugated to a self-assembling protein nanoparticle carrier. The immunogenic conjugate provides a multivalent platform with superior binding capability for engaging HIV-1 Env fusion peptide-directed broadly neutralizing antibodies and can be used, for example, to prime an immune response in a subject that targets the HIV-1 Env fusion peptide epitope.

Figure 1C:
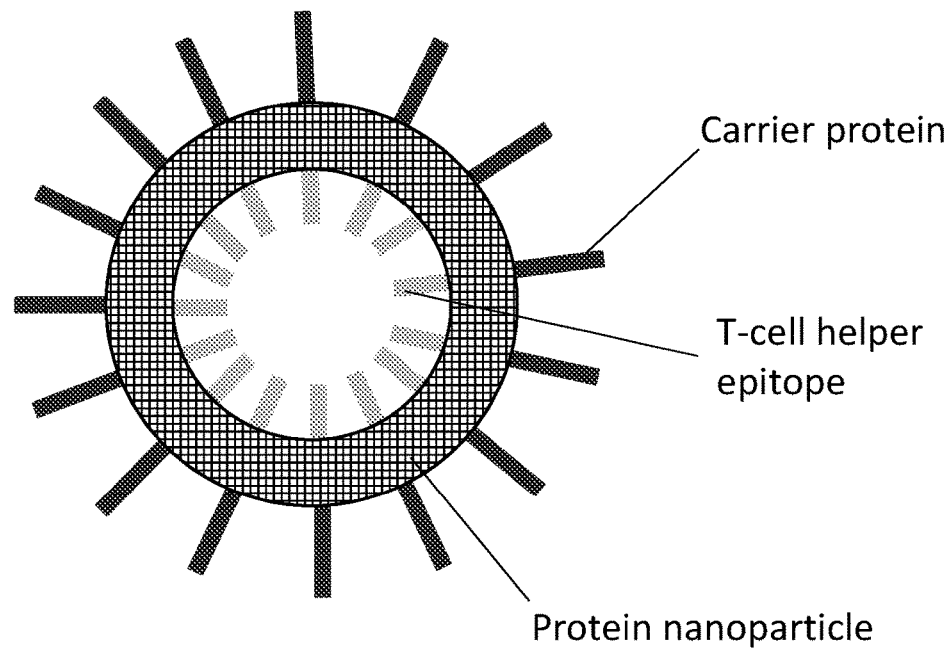
Figure 1C:
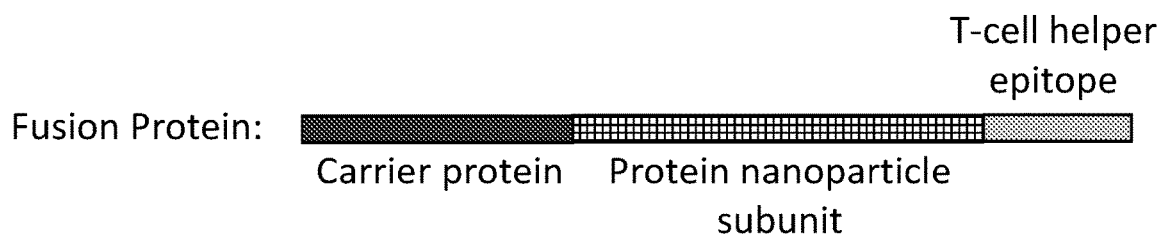

FIG. 1 illustrates the design of certain embodiments of the immunogenic conjugate. As shown in FIG. 1A, the self-assembling protein nanoparticle carrier is a multimer of fusion proteins, each including a self-assembling protein nanoparticle subunit fused to a heterologous carrier protein. In some embodiments, the fusion protein can further include a T-cell helper epitope (FIG. 1B), which is then included in the self-assembling protein nanoparticle carrier. The location of the T-cell-helper epitope can be varied in the fusion protein. As shown in FIGS. 1C-1I, the HIV-1 Env fusion peptides (FP) are conjugated to the self-assembling protein nanoparticle carrier. FIGS. 1G-1I illustrate additional embodiments that further include a targeting moiety that targets the immune system in a subject to enhance the immune response to the HIV-1 Env fusion peptide on the immunogenic conjugate. The HIV-1 Env fusion peptides and the targeting moiety can be conjugated to any suitable aspect of the self-assembling protein nanoparticle carrier. In some instances, sulfosuccinimidyl (4-iodoacetyl)aminobenzoate (Sulfo-SIAB) conjugation chemistry is used to conjugate the HIV-1 Env fusion peptides and/or the targeting moiety to exposed lysine residues of the self-assembling protein nanoparticle carrier.

Example 2

HIV-1 Env Fusion Peptide Immunization Using a Nanoparticle Format

Figure 2:
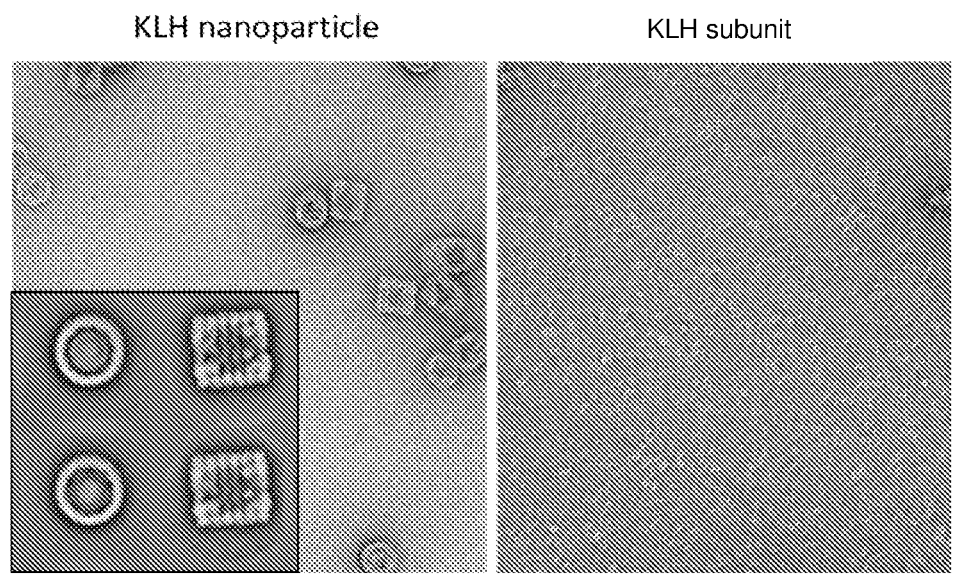
FIG. 2 shows a set of images illustrating structural differences between KLH nanoparticles and KLH subunits, and a graph presenting data showing that immunization with KLH nanoparticles conjugated to FP8 peptide (AVGIGAVF, residues 1-8 of SEQ ID NO: 1) elicits a much greater immune response to the HIV-1 Env trimer than immunization with KLH subunit conjugated to FP8 peptide.
Figure 2:
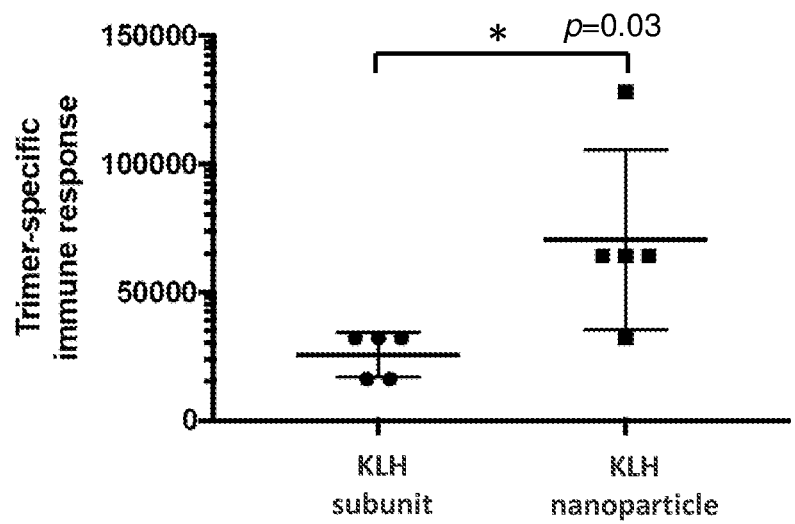

To illustrate the effectiveness of the nanoparticle format for immunization with the HIV-1 Env fusion peptide, the FP8 peptide (AVGIGAVF, residues 1-8 of SEQ ID NO: 1) was conjugated to KLH nanoparticles or to KLH monomeric subunits (FIG. 2). The resulting conjugates were administrated to mice, and immune sera assessed for binding to BG505 HIV-1 Env trimer. As shown in FIG. 2 the nanoparticle based immunogen elicited a much greater immune response to the HIV-1 Env trimer than the subunit-based immunogen.

Example 3

Nanoparticle-Carriers for Display of Vaccine Antigens

This example illustrates self-assembling protein nanoparticles fused to heterologous carrier proteins for display of vaccine antigens.

Using structure based design, protein nanoparticle subunits were selected for genetic fusion with heterologous carrier proteins by a variety of peptide linkers.

The nanoparticle subunits were ferritin subunits, lumazine synthase subunits, encapsulin subunits, DNA starvation/stationary phase protection protein subunits, T4 fibritin subunits, Sulfur Oxygenase Reductase subunits, Bacteriophage Q Beta Capsid protein (qbeta) subunits, Dihydrolipoyl transacetylase protein (e2p) subunits, Phosphopantetheine Adenylyltransferase (6ccq) subunits, Glutamate Synthase (1f52) subunits, Calcium/calmodulin dependent protein kinase IIa (CaMKIIa) C-terminal fragment (5U6Y) subunits, HIV capsid oligomerization domain subunits, Hexamer subunits, *Acinetobacter* phage AP205 subunits, and Hepatitis B capsid subunits.

The heterologous carrier proteins were tetanus toxin heavy chain C fragment (rTT), diphtheria toxin variant CRM197 (CRM197), *H. influenzae* protein D, Keyhole Limpet Hemocyanin (KLH) functional unit, Meningococcal outer membrane protein complex protein, Outer-membrane lipoprotein carrier protein, and Cholera toxin B subunit.

The linkers were an IgG hinge, a camel IgG2a hinge, a CD8 hinge, and a glycine serine linker Combinations of self-assembling nanoparticle subunit, heterologous carrier, and linker were assessed computationally for formation of a multimerized protein nanoparticle with the heterologous carrier protein fused to each subunit displayed on the exterior surface of the nanoparticle. These design assays led to the identification of the fusion proteins set forth as SEQ ID NOs: 72-219, 246-257, and 331-397, which self-assemble to form nanoparticle carrier proteins.

To illustrate the nanoparticle-forming capacity of the identified fusion proteins, a fusion protein containing a lumazine synthase nanoparticle subunit fused to rTT by a 20 amino acid peptide linker (LS-20-rTT) was assessed for nanoparticle self-assembly (FIG. 3). The fusion protein is depicted in FIG. 3A and the sequence is set forth as SEQ ID NO: 73. A mammalian expression construct encoding LS-20-rTT was expressed in mammalian cells using a standard protocol for generating lumazine synthase nanoparticles (see, Zhang et al. "X-ray structure analysis and crystallographic refinement of lumazine synthase from the hyperthermophile *Aquifex aeolicus* at 1.6 Å resolution: determinants of thermostability revealed from structural comparisons." *J Mol Biol.*, 306(5):1099-114, 2001 and Duan et al., "Glycan Masking Focuses Immune Responses to the HIV-1 CD4-Binding Site and Enhances Elicitation of VRC01-Class Precursor Antibodies," *Immunity*, 49(2):301-311, 2018, each of which is incorporated by reference herein), and the resulting nanoparticles self-assemble in the tissue culture media. The nanoparticles were purified and separated by size-exclusion chromatography (FIG. 3B) and assessed by electron microscopy (FIG. 3C). As shown, the resulting nanoparticles are uniform and stable, and ready for conjugation with vaccine antigen.

Additionally, a fusion protein containing a lumazine synthase nanoparticle subunit fused to rTT by an IgG hinge linker (LS-hinge2-rTT) was assessed for nanoparticle self assembly (FIG. 4). The fusion protein sequence is set forth as SEQ ID NO: 362. A mammalian expression construct encoding LS-hinge2-rTT was expressed in mammalian cells as above, and the resulting nanoparticles were purified and assessed by electron microscopy. Again, the resulting nanoparticles are uniform and stable, and ready for conjugation with vaccine antigen.

Figure 5:
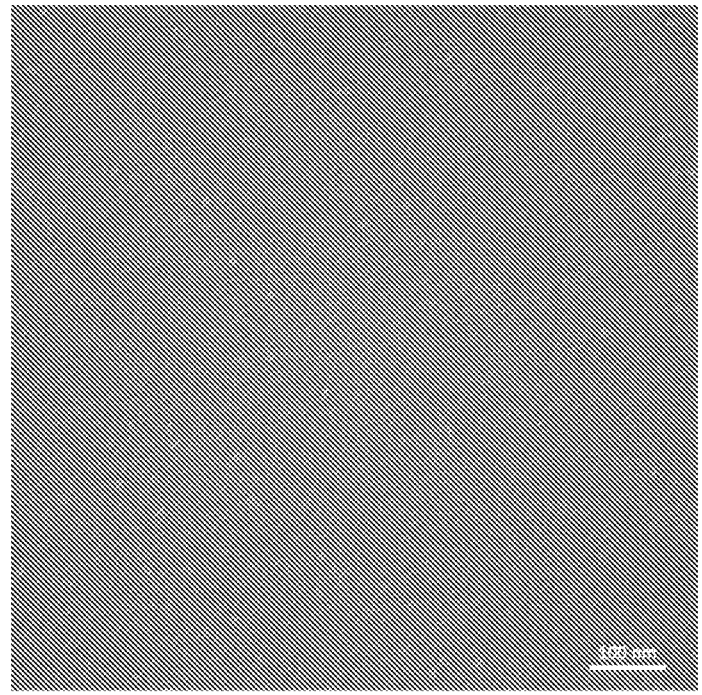
FIG. 5 shows electron micrographs for another example of a genetically fused nanoparticle carrier, formed from subunits of *H. influenzae* protein D fused to phosphopantetheine adenylyltransferase nanoparticle subunit fused to rTT (HiD-6CCQ-rTT). The sequence of the fusion protein used to generate these nanoparticle carrier is provided as SEQ ID NO: 179. The observed particles were generally consistent in size and shape with the known phosphopantetheine adenylyltransferase crystal structure (PDB 6CCQ).
Figure 5:
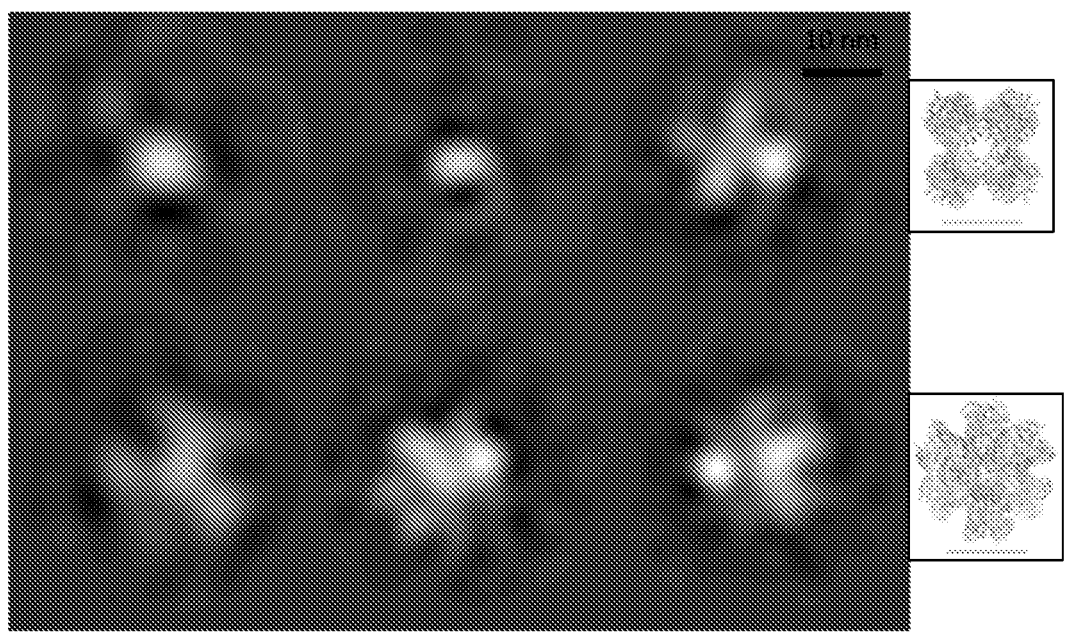

Additionally, a fusion protein containing a phosphopantetheine adenylyltransferase nanoparticle subunit was assessed for nanoparticle self assembly (FIG. 5). This fusion protein contained two carrier proteins: the fusion protein contained *H. influenzae* protein D carrier fused to the phosphopantetheine adenylyltransferase nanoparticle subunit fused to rTT carrier (HiD-6CCQ-rTT). The fusion protein sequence is set forth as SEQ ID NO: 179. A mammalian expression construct encoding HiD-6CCQ-rTT was expressed in mammalian cells as above, and the resulting nanoparticles were purified and assessed by electron microscopy. The observed particles were generally consistent in size and shape with the known phosphopantetheine adenylyltransferase crystal structure (PDB 6CCQ). Again, the resulting nanoparticles are uniform and stable, and ready for conjugation with vaccine antigen.

Example 4

Conjugation of HIV-1 Env Fusion Peptide to Nanoparticle Carrier

The following provides a non-limiting example of a method of conjugating a HIV-1 Env fusion peptide (FP8, AVGIGAVF, residues 1-8 of SEQ ID NO: 1) to a self-assembling protein nanoparticle carrier (formed from LS-PADRE-Env31-rTT fusion proteins, SEQ ID NO: 76) via a sulfosuccinimidyl (4-iodoacetyl)aminobenzoate (Sulfo-SIAB) linker. The protocol used to link the fusion peptide to carrier can be performed according to standard methods (see, e.g., Hermanson. Bioconjugation Techniques, 3$^{rd}$ ed., Chap. 6, p. 306-308. Academic Press, 2013). Briefly, the conjugation protocol includes:

Expression of the Self-Assembling Protein Nanoparticle Carrier

An expression construct encoding the LS-PADRE-Env31-rTT fusion protein (SEQ ID NO: 76) including an N-terminal signal peptide is expressed in HEK 293 Freestyle cells. The fusion proteins are secreted from the cells and self-assemble into the protein nanoparticle carrier in the supernatant. The resulting protein nanoparticle carrier is purified using chromatography procedures, including anion exchange followed by size exclusion chromatography.

Activation of LS-PADRE-Env31-rTT Nanoparticle Carrier:
1. Prepare 10 mM stock of sulfo-SIAB crosslinker
2. Prepare a 1 mg/mL LS-PADRE-Env31-rTT nanoparticle carrier stock in conjugation buffer (10% glycerol, 50 mM Na/KPO$_4$ buffer, pH 8.5, 1 mM EDTA).
3. Add sulfo-SIAB to LS-PADRE-Env31-rTT nanoparticle carrier using a 1:1 molar ratio of crosslinker to total Lys on LS-PADRE-Env31-rTT nanoparticle carrier
4. Let reaction proceed at 25° C. (room temperature) for 1 hr.
5. At 4° C., pass through a 10 ml Zebra Spin Desalting Column, 7K MWCO (Thermofisher) to remove low molecular weight compounds.

Conjugation of Peptide to Activated Carrier:
1. Prepare a 12 mM stock of FP8 peptide.
2. Allow activated LS-PADRE-Env31-rTT nanoparticle carrier to warm up to 25° C. (room temperature). Gradually add peptide to activated carrier using a 1:1 (w/w) ratio.
3. Spin for 2 min; use supernatant and discard precipitate.
4. Incubate reaction supernatant at 4° C. overnight.
5. Use a 10 ml Zebra Spin Desalting Column, 7K MWCO (Thermofisher) to remove low molecular weight compounds.
6. Dialyze conjugate against 1×PBS.
7. Analyze product: degree of conjugation by mass spectrometry and antigenic properties by Octet.

Following purification of the FPB-LS-PADRE-Env31-rTT nanoparticle carrier conjugate, antigenicity can be assessed by binding to fusion peptide specific antibody VRC34.

The conjugation protocol and chemistry illustrated in this example can readily be extended to other fusion peptide sequences and other carrier proteins.

Example 5

Nanoparticle-Carriers Conjugated to Vaccine Antigens and Related Immunization Assays This example illustrates self-assembling protein nanoparticles fused to a heterologous carrier and conjugated to vaccine antigens (HIV-1 Env fusion peptide) and immunization therewith.

Figure 6A:
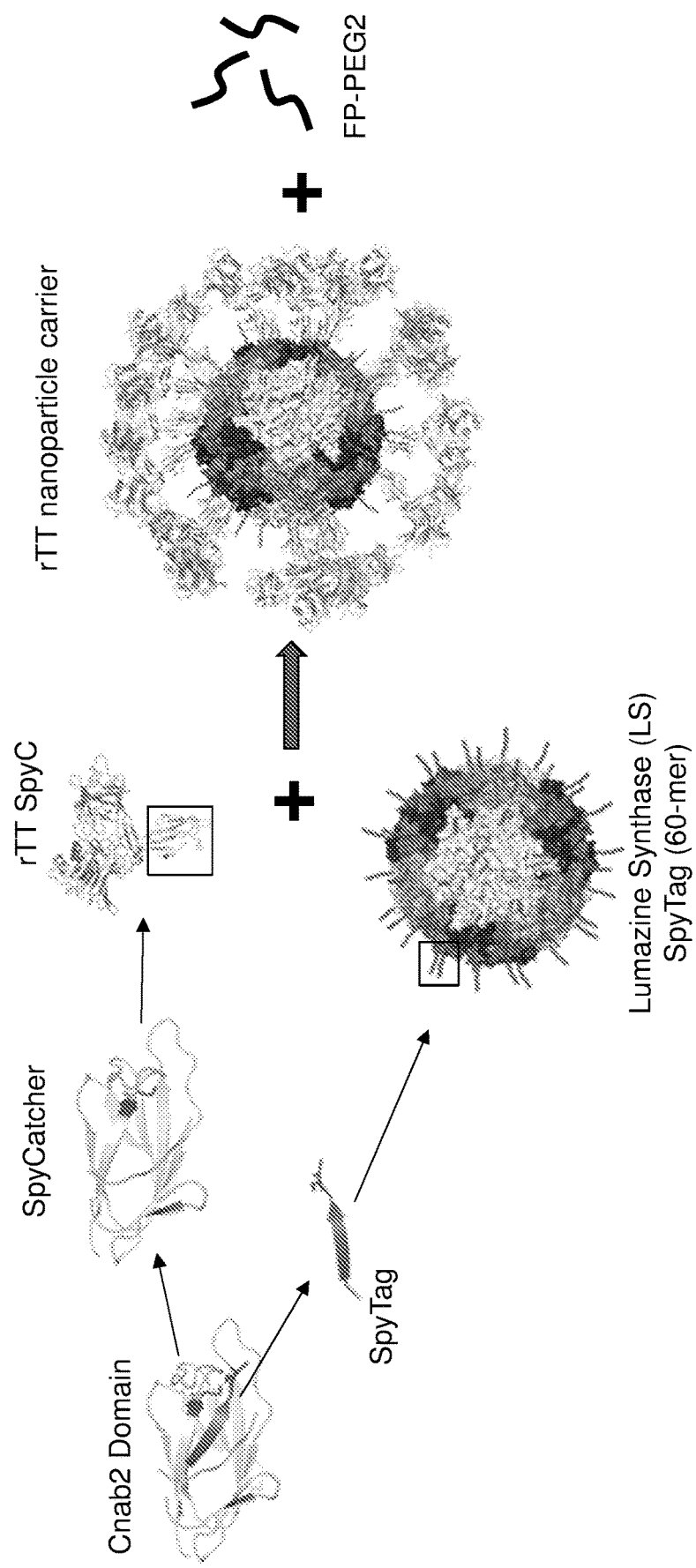
FIGS. 6A-6C shows a nanoparticle carrier assembled through isopeptide bond fusion of lumazine synthase nanoparticle subunit and rTT carrier.
Figure 6B:
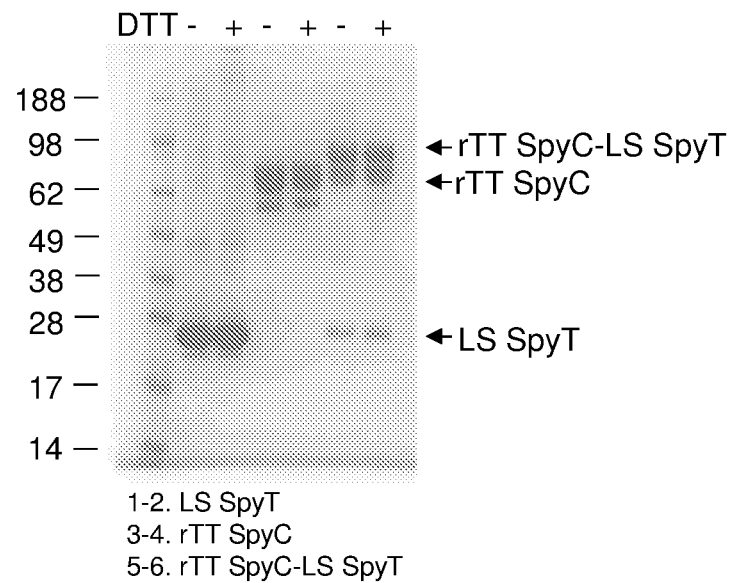
Figure 6C:
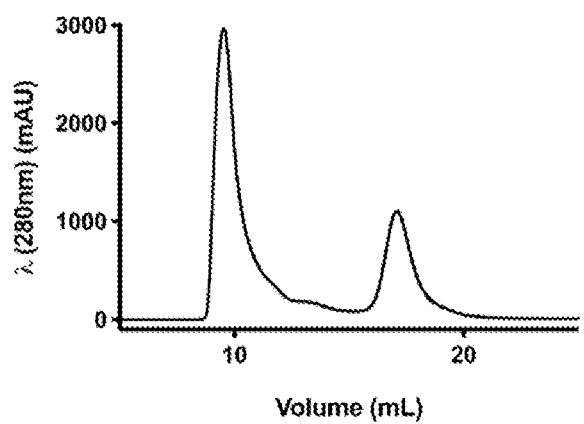
Figure 7:
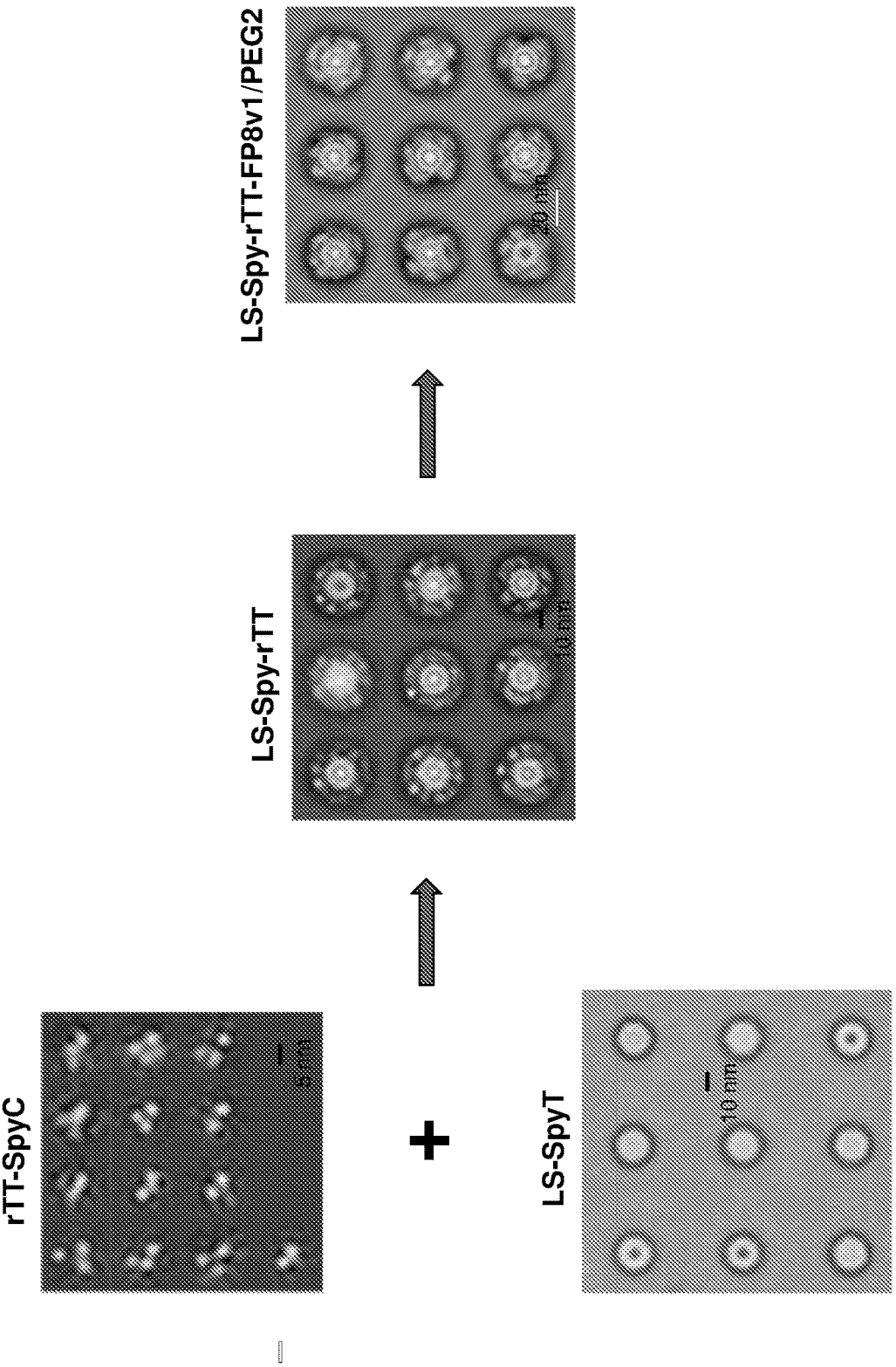
FIG. 7 is a series of electron micrograph images of the purified rTT-SpyC fusion protein, the LS-SpyT nanoparticle, the LS-SpyT nanoparticle joined to the rTT-SpyC fusion protein (LS-Spy-rTT), and the LS-SpyT nanoparticle joined to the rTT-SpyC fusion protein further conjugated to HIV-1 Env fusion peptide FP8v1 by a PEG linker (LS-Spy-rTT-FP8v1/PEG2).

For the assays described in this example, the nanoparticle subunit was linked to the heterologous carrier by isopeptide bond using the spytag/spycatcher linkage system. FIG. 6 depicts the construction and purification protocol. rTT carrier was genetically fused to the spycatcher tag, and the lumazine synthase subunit was genetically fused to the spytag. The sequence of the LS-spytag fusion is provided as SEQ ID NO: 399. The sequence of the rTT-spycatcher fusion is provided as SEQ ID NO: 407. The rTT-spyC fusion protein was produced and purified, and lumazine synthase nanoparticles formed form the LS-spytag fusion were produced purified. The rTT-spyC fusion protein and the lumazine synthase nanoparticles formed form the LS-spytag fusion were mixed, allowing the spytag/spycatcher proteins to spontaneously join by isopeptide bond, resulting in a lumazine synthase nanoparticle linked to rTT via the spycatcher/tag linker Subsequently, the FP8 fusion peptide was conjugated to the purified nanoparticle-carrier by a PEG linker The structure of rTT-spyC, LS-SpyT, LS-Spy-rTT, and LS-Spy-rTT-FP8 were assessed by EM (FIG. 7). Further, the LS-Spy-rTT-FP8 nanoparticle carrier was assessed for the number of conjugated HIV-1 Env fusion peptides using ITC, and this was compared to the corresponding number of HIV-1 Env fusion peptides conjugated to monomeric rTT (FIG. 8). The results show that each FP-rTT monomer entity has six competent VRC34.01 Fab binding sites, whereas each LS-Spy-rTT-FP8v1/PEG2 nanoparticle carrier has 152-402 competent VRC34.01 Fab binding sites. The VRC34.01 antibody specifically binds to the HIV-1 Env fusion peptide.

Figure 9:
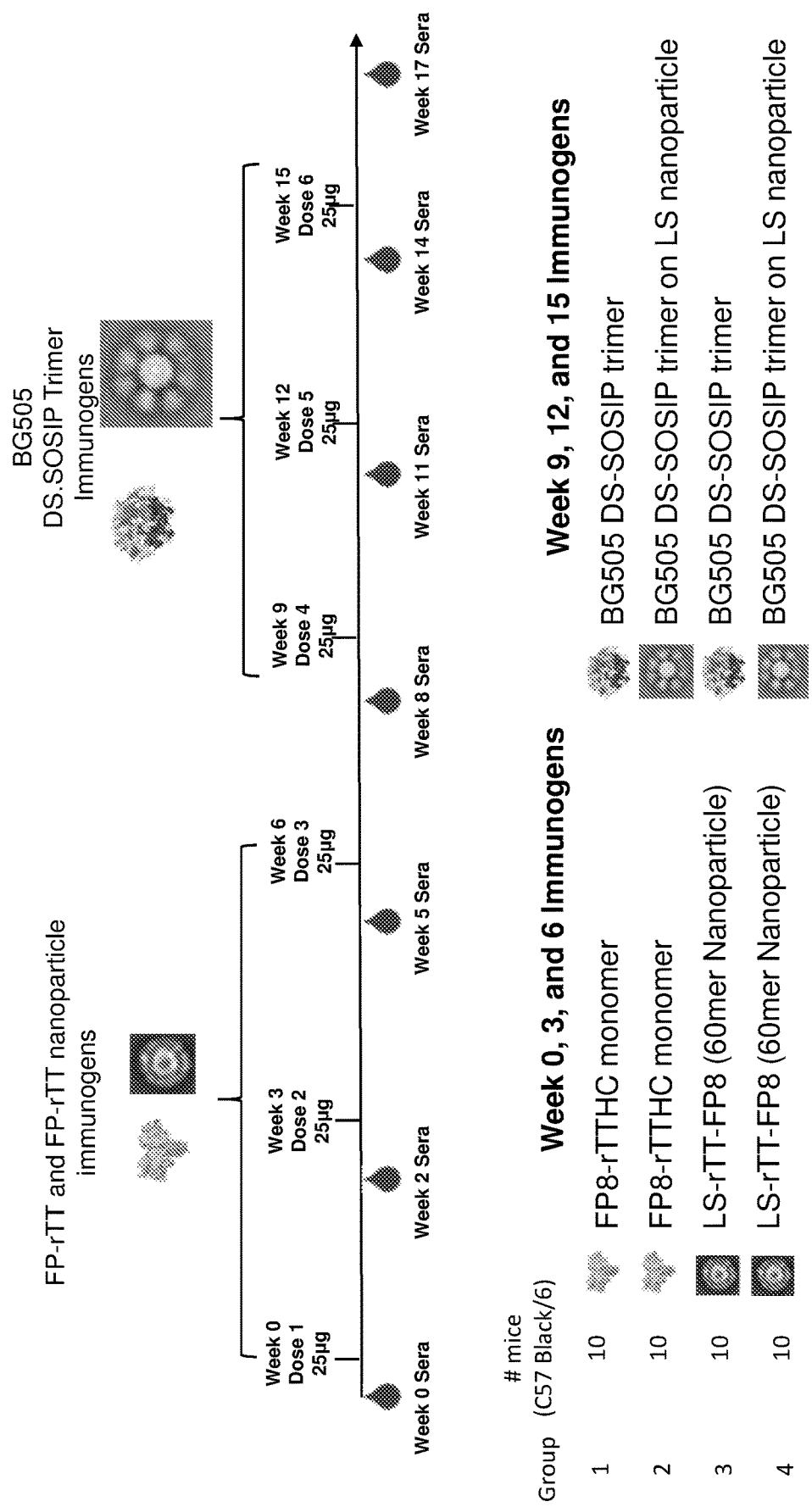
FIG. 9 depicts an immunization protocol used to assess the LS-Spy-rTT-FP8v1/PEG2 nanoparticle carrier. For the first three immunizations (weeks 0, 3, and 6), mice received a 25 μg dose of either FP8v1-rTT monomer (Groups 1 and 2) or LS-Spy-rTT-FP8v1/PEG2 nanoparticle carrier (Groups 3 and 4). For the following three immunizations, mice received a 25 μg dose of either BG505 DS-SOSIP trimer (Groups 1 and 3) or the BG505 DS-SOSIP trimer conjugated to a lumazine synthase nanoparticle (Groups 2 and 4). Adjuplex was used as adjuvant for each immunization. Blood was drawn at weeks 0, 2, 5, 8, 11, 14, and 17.

The immunogenicity of the LS-Spy-rTT-FP8v1/PEG2 nanoparticle carrier was assessed in a mouse model. The immunization protocol is shown in FIG. 9. For the first three immunizations (weeks 0, 3, and 6), mice received a 25 µg dose of either FP8v1-rTT monomer (Groups 1 and 2) or LS-Spy-rTT-FP8v1/PEG2 nanoparticle carrier (Groups 3 and 4). For the following three immunizations, mice received a 25 µg dose of either BG505 DS-SOSIP trimer (Groups 1 and 3) or the BG505 DS-SOSIP trimer conjugated to a lumazine synthase nanoparticle (Groups 2 and 4). BG505 DS-SOSIP trimer is a known HIV-1 Env immunogen described in Kwon et al. ("Crystal structure, conformational fixation and entry related interactions of mature ligand-free HIV-1 Env," Nat Struct Biol., 22(7):522-531, 2015, incorporated by reference herein). For these assays BG505 DS-SOSIP trimer was linked to lumazine synthase nanoparticles by standard conjugation chemistry. Blood was drawn at weeks 0, 2, 5, 8, 11, 14, and 17.

Thus, this immunization assay interrogates the ability of the LS-Spy-rTT-FP8v1/PEG2 nanoparticle carrier to generate an immune response in an animal model, and also whether this construct can prime an immune response for subsequent immunization with HIV-1 Env trimer.

Figure 10A:
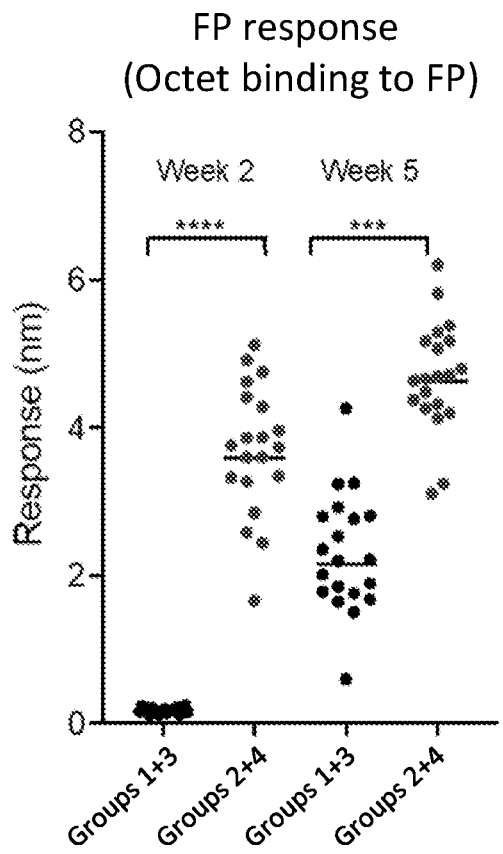
FIGS. 10A-10C show binding and neutralization characteristics for sera from FP-immunized mice.
Figure 10B:
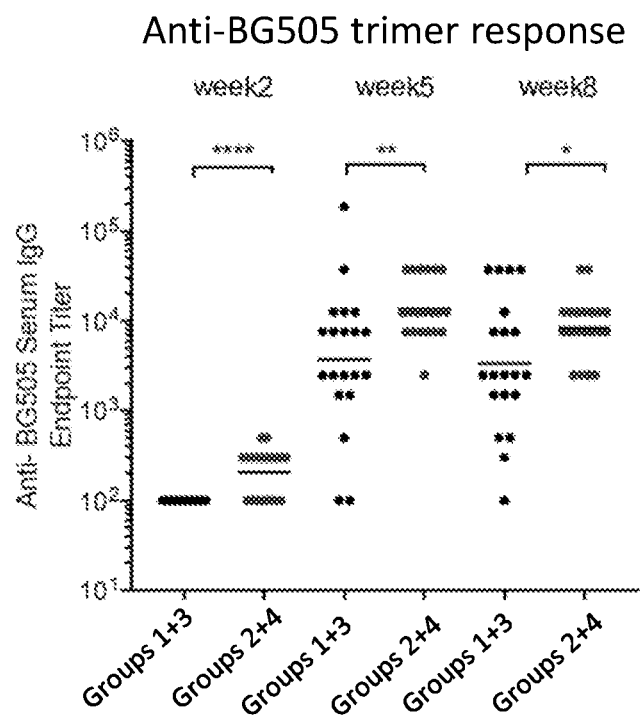
Figure 10C:
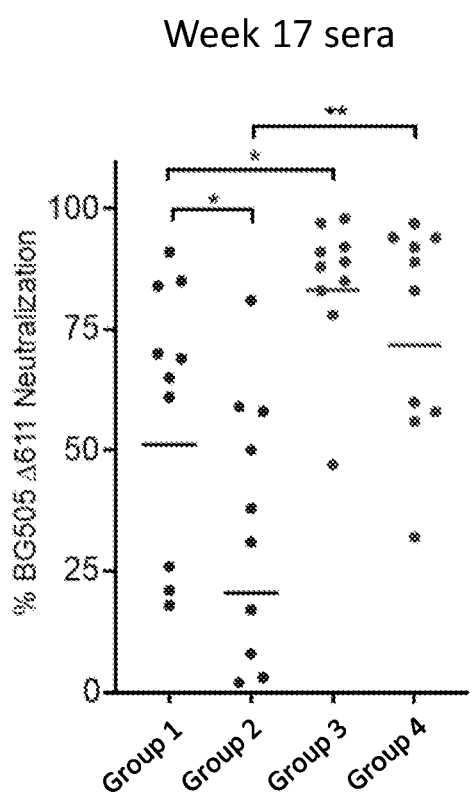

As shown in FIG. 10, the LS-Spy-rTT-FP8v1/PEG2 immunogen elicited a far superior immune response to HIV-1 Env fusion peptide compared to monomeric FP-rTT (FIGS. 10A and 10B), and also provided superior priming for subsequent immunization with the BG505 trimer or BG505 trimer on lumazine synthase particle. These results illustrate the effectiveness of the self-assembled protein nanoparticle carrier fusion for use as a immunization tool.

Example 6

Disulfide-Stabilized Nanoparticle Subunits for Nanoparticle Carriers

This example illustrates self-assembling protein nanoparticles fused to heterologous carrier proteins for display of vaccine antigens that are modified to contain a non-native disulfide bond to increase retention of the nanoparticle format.

Using structure based design, self-assembling protein nanoparticle subunits were mutated to contain one or more cysteine substitutions to introduce a non-native disulfide bond that stabilizes the corresponding nanoparticle formed by the subunits. Stabilization increases resistance to disassembly of the nanoparticle compared to a corresponding native subunit sequence under similar conditions. The mutations were assessed computationally to determine whether they would form a disulfide bond that would stabilize the resulting nanoparticle.

Based on this assessment, ferritin subunits set forth as SEQ ID NOs: 258-305, lumazine synthase subunits set forth as SEQ ID NOs: 306-312, encapsulin subunits set forth as SEQ ID NOs: 313-315, *Acinetobacter* phage AP205 subunits set forth as SEQ ID NOs: 317-320, and Hepatitis B capsid subunits set forth as SEQ ID NOs: 322-326, were identified, which self-assemble to form nanoparticles containing one or more non-native disulfide bonds that stabilize that nanoparticle relative to nanoparticles formed from unmodified subunits. Specific examples of the disulfide stabilized protein nanoparticles fused to carrier proteins are provided as SEQ ID NOs: 331-354, 369-387, 394-397.

Figure 11:
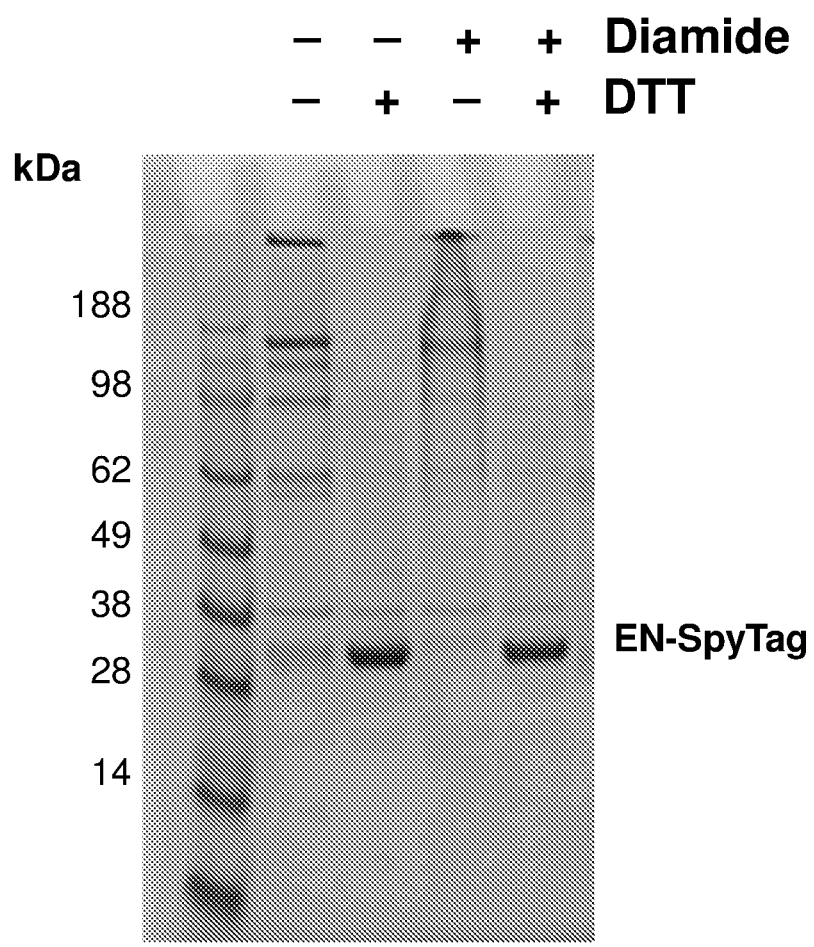
FIG. 11 shows a SDS-PAGE gel illustrating purification of an encapsulin nanoparticle subunit fused to a spytag. The encapsulin subunit includes G53C-R94C mutations to introduce a disulfide bond that stabilizes nanoparticles formed for the subunit.
Figure 12:
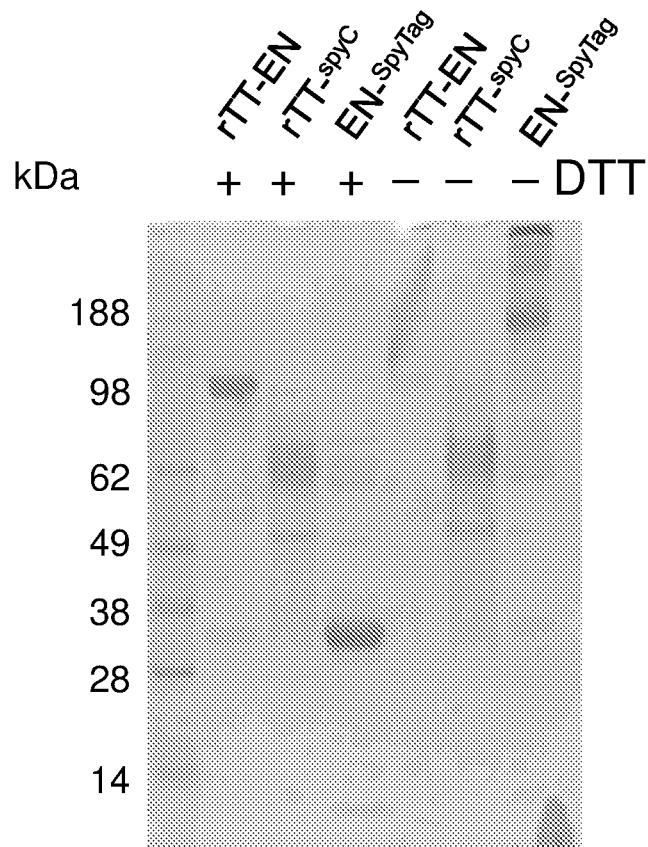
FIG. 12 shows a SDS-PAGE gel illustrating purification of an encapsulin nanoparticle subunit fused to a spytag (EN-spytag), rTT carrier fused to a spycatcher moiety (rTT-spyC), and the encapsulin-rTT fusion (rTT-EN) formed from these two molecules. The encapsulin subunit includes G53C-R94C mutations to introduce a disulfide bond that stabilizes nanoparticles formed for the subunit.
Figure 13:
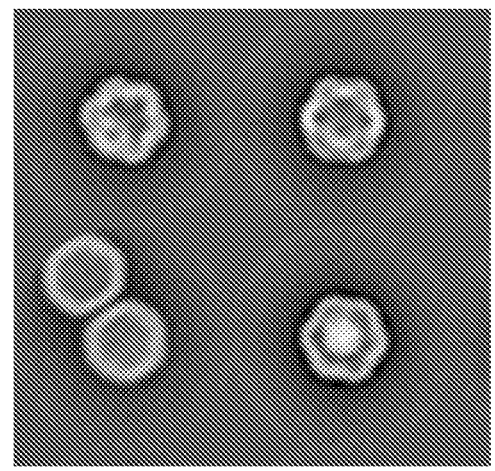
FIG. 13 shows a series of electron micrograph images of the purified encapsulin-spytag, rTT-spy-encapsulin fusion, and FP8v1-rTT-spy-encapsulin.
Figure 13:
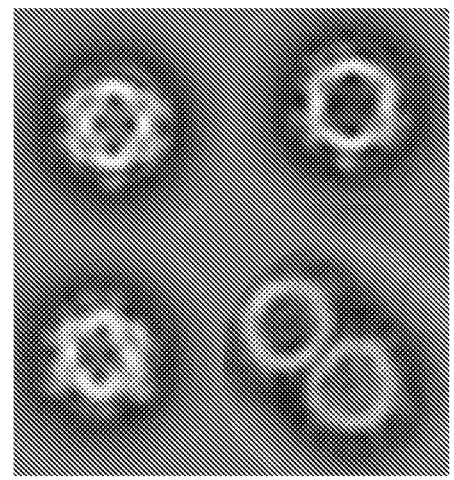
Figure 13:
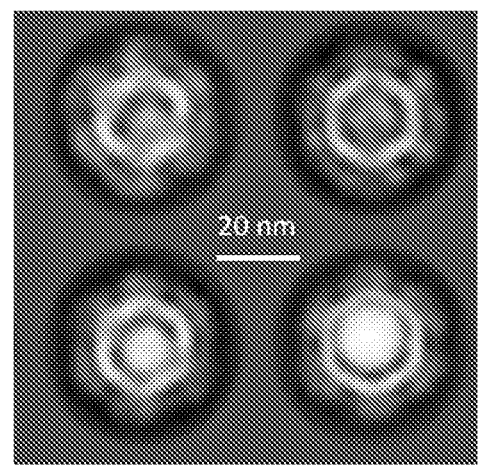

To illustrate the nanoparticle-forming capacity of subunits containing the indicated disulfide bonds, an encapsulin subunit containing G53C-R94C mutations to introduce a stabilizing disulfide bond was fused to a spytag, expressed in cells and the corresponding self-assembled nanoparticles were purified and mixed with rTT-spycatcher (FIGS. 11-13) to form encapsulin-rTT nanoparticle carriers, with the carrier protein linked to the nanoparticle via the spytag/catcher isopeptide bond. The sequence of the encapsulin G53C-R94C spytag fusion is provided as SEQ ID NO: 410, and the sequence of the rTT-spycatcher is provided as SEQ ID NO: 407. The purified nanoparticle-carrier was conjugated to FP8 fusion protein using a SIAB linker FIG. 13 shows by EM that the resulting HIV-1 Env fusion peptide nanoparticle carrier is uniform and stable.

It will be apparent that the precise details of the methods or compositions described may be varied or modified without departing from the spirit of the described embodiments. We claim all such modifications and variations that fall within the scope and spirit of the claims below.

SEQUENCE LISTING (410 sequences)

SEQ ID NO: 1 - protein, 10 aa, Human Immunodeficiency Virus type 1
AVGIGAVFLG

SEQ ID NO: 2 - protein, 10 aa, Human Immunodeficiency Virus type 1
AVGLGAVFLG

SEQ ID NO: 3 - protein, 10 aa, Human Immunodeficiency Virus type 1
AVGIGAMIFG

SEQ ID NO: 4 - protein, 11 aa, Human Immunodeficiency Virus type 1
AVGTIGAMFLG

SEQ ID NO: 5 - protein, 10 aa, Human Immunodeficiency Virus type 1
AVGIGAMFLG

SEQ ID NO: 6 - protein, 10 aa, Human Immunodeficiency Virus type 1
AVGIGALFLG

SEQ ID NO: 7 - protein, 10 aa, Human Immunodeficiency Virus type 1
AIGLGAMFLG

SEQ ID NO: 8 - protein, 10 aa, Human Immunodeficiency Virus type 1
AVGLGAVFIG

SEQ ID NO: 9 - protein, 10 aa, Human Immunodeficiency Virus type 1
AVGIGAVLLG

SEQ ID NO: 10 - protein, 10 aa, Human Immunodeficiency Virus type 1
AVGIGAVFIG

SEQ ID NO: 11 - protein, 10 aa, Human Immunodeficiency Virus type 1
AIGLGALFLG

SEQ ID NO: 12 - protein, 9 aa, Human Immunodeficiency Virus type 1
AALGAVFLG

SEQ ID NO: 13 - protein, 856 aa, Human Immunodeficiency Virus type 1
MRVKEKYQHLWRWGWRWGTMLLGMLMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLKNDTNTNSSSGRMIMEKGEIKNCSFNISTSIRGKVQKEYAFFYKLDIIPIDNDTTSYKLTSCNTSVITQACPKVSFEPIPIHYCAPAGFAILKCNNKTFNGTGPCTNVSTVQCTHGIRPVVSTQLLLNGSLAEEEVVIRSVNFTDNAKTIIVQLNTSVEINCTRPNNNTRKRIRIQRGPGRAFVTIGKIGNMRQAHCNISRAKWNNTLKQIASKLREQFGNNKTIIFKQSSGGDPEIVTHSFNCGGEFFYCNSTQLFNSTWFNSTWSTEGSNNTEGSDTITLPCRIKQIINMWQKVGKAMYAPPISGQIRCSSNITGLLLTRDGGNSNNESEIFRPGGGDMRDNWRSELYKYKVVKIEPLGVAPTKAKRRVVQREKRAVGIGALFLGFLGAAGSTMGAASMTLTVQARQLLSGIVQQQNNLLRAIEAQQHLLQLTVWGIKQLQARILAVERYLKDQQLLGIWGCSGKLICTTAVPWNASWSNKSLEQIWNHTTWMEWDREINNYTSLIHSLIEESQNQQEKNEQELLELDKWASLWNWFNITNWLWYIKLFIMIVGGLVGLRIVFAVLSIVNRVRQGYSPLSFQTHLPTPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

SEQ ID NO: 14 - protein, 163 aa, Artificial Sequence
  Recombinant ferritin protein
DIEKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 15 - protein, 163 aa, Artificial Sequence
  Recombinant ferritin protein
DIIKLLNEQVNKEMQSSNLYMSMSSWCYTHSLDGAGLFLFDHAAEEYEHAKKLIIFLNENNVPVQLTSISAPHHKFHGLTHIFHKAYHHEQHISESINNIVDHAIKSKDHATFNFLQWYVAEQHEEEVLFKDILDKIELIGNENHGLYLADQYVKGIAKSRKS

SEQ ID NO: 16 - protein, 163 aa, Artificial Sequence
  Recombinant ferritin protein
DIIKLLNEQVNKEMNSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 17 - protein, 163 aa, Artificial Sequence
  Recombinant ferritin protein
DIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 18 - protein, 163 aa, Artificial Sequence
  Recombinant ferritin protein
DIIKLLNEQVNKEMDSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 19 - protein, 141 aa, Artificial Sequence
  Recombinant ferritin protein
DIIKLLNEQVNKEMNSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIG

SEQ ID NO: 20 - protein, 144 aa, Artificial Sequence
  Recombinant ferritin protein
DIIKLLNEQVNKEMNSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNEN

SEQ ID NO: 21 - protein, 173 aa, Artificial Sequence
  Recombinant ferritin protein
RSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 22 - protein, 183 aa, Artificial Sequence
  Recombinant ferritin protein
EYGSHGNVATELQAYAKLHLERSYDYLLSAAYFNNYQTNRAGFSKLFKKLSDEAWSKTIDIIKHVTKRGDKMNFDQHSTMKTERKNYTAENHELEALAKALDTQKELAERAFYIHREATRNSQHLHDPEIAQYLEEEFIEDHAEKIRTLAGHTSDLKKFITANNGHDLSLALYVFDEYLQKTV

SEQ ID NO: 23 - protein, 173 aa, Artificial Sequence
  Recombinant ferritin protein
RSCRDSMRRQIQMEVGASLQYLAMGAHFSKDKINRPGFAKLFFDAAGEEREHAMKLIEYLLMRGELTNDVTSLIQVRAPQRNKWEGGVDALEHALKMESDVTKSIRTVIKACEDDPEFNDYHLVDYLTGEFLEEQYKGQRDLAGKASTLKKMLDRNSALGEFIFDKKLMGMDI

SEQ ID NO: 24 - protein, 184 aa, Artificial Sequence
  Recombinant ferritin protein
EYGHHGNVAKEMQAYAALHLERSYEYLLSSSYFNNYQTNRAGFSKLFRKLSDDAWEKTIDLIKHITMRGDEMNFAQRSTQKSVDRKNYTVELHELESLAKALDTQKELAERAFFIHREATRNSQHLHDPEVAQYLEEEFIEDHAKTIRNLAGHTTDLKRFVSGDNGQDLSLALYVFDEYLQKTV

SEQ ID NO: 25 - protein, 154 aa, Artificial Sequence
  Recombinant lumazine synthase protein
MQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 26 - protein, 153 aa, Artificial Sequence
  Recombinant lumazine synthase protein
QIYEGKLTAEGLRFGIVASRFNHALVDRLVEGCIDCIVRHGGREEDITLVRVPGSWEIPVAAGELARKEDIDAVIAIGVLIRGATPHFDYIASEVSKGLANLSLELRKPITFGVITADTLEQAIERAGTKHGNKCWEAALSAIEMANLFKSLR

SEQ ID NO: 27 - protein, 153 aa, Artificial Sequence
  Recombinant lumazine synthase protein
QIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPITFGVITADTLEQAIERAGTKHGNKGWEAALSAIEMANLFKSLR

SEQ ID NO: 28 - protein, 153 aa, Artificial Sequence
  Recombinant lumazine synthase protein
QIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 29 - protein, 157 aa, Artificial Sequence
  Recombinant DNA starvation/stationary phase protection protein
SATTTLKEQVLTTLKREQANAVVMYLNYKKYHWLTYGPLFRDLHLLFEEQGSEVFAMIDELAERSLMLDGQPVADPADYLKVATVTPSSGQLTVKQMIEEAIANHELIITEMHQDAEIATEAGDIGTADLYTRLVQTHQKHRWFLKEFLAKGDGLVS

SEQ ID NO: 30 - protein, 168 aa, Artificial Sequence
  Recombinant DNA starvation/stationary phase protection protein
TTIHDVQTTGLTQDAVTGFDASSRLNAGLQEVLVDLTALHLQGKQAHWNIVGENWRDLHLQLDTLVEAARGFSDDVAERMRAVGGVPDARPQTVAASRIGDVGPDEIDTRACVEAIVALVRHTVDTIRRVHDPIDAEDPASADLLHAITLELEKQAWMIGSENRSPRR

SEQ ID NO: 31 - protein, 183 aa, Artificial Sequence
  Recombinant DNA starvation/stationary phase protection protein
SETQTLLRNFGNVYDNPVLLDRSVTAPVTEGFNVVLASFQALYLQYQKHHFVVEGSEFYSLHEFFNEAYNQVQDHIHEIGERLDGLGGVPVATFSKLAELTCFEQESEGVYSSRQMVENDLAAEQAIIGVIRRQAAQAESLGDRGTRYLYEKILLKTEERAYHLSHFLAKDSLTLGFVQAAQS

SEQ ID NO: 32 - protein, 132 aa, Artificial Sequence
  Recombinant Bacteriophage Q Beta Capsid protein
AKLETVTLGNIGKDGKQTLVLNPRGVNPTNGVASLSQAGAVPALEKRVTVSVSQPSRNRKNYKVQVKIQNPTACTANGACDPSVTRQAYADVTFSFTQYSTDEERAFVRTELAALLASPLLIDAIDQLNPAY

SEQ ID NO: 33 - protein, 242 aa, Artificial Sequence
  Recombinant Dihydrolipoyl transacetylase protein
AAAKPATTEGEFPETREKMSGIRRAIAKAMVHSKHTAPHVTLMDEADVTKLVAHRKKFKAIAAEKGIKLTFLPYVVKALVSALREYPVLNTAIDDETEEIIQKHYYNIGIAADTDRGLLVPVIKHADRKPIFALAQEINELAEKARDGKLTPGEMKGASCTITNIGSAGGQWFTPVINHPEVAILGIGRIAEKPIVRDGEIVAAPMLALSLSFDHRMIDGATAQKALNHIKRLLSDPELLLM

SEQ ID NO: 34 - protein, 161 aa, Artificial Sequence
  Recombinant Phosphopantetheine Adenylyltransferase
MQKRAIYPGTFDPITNGHIDIVTRATQMFDHVILAIAASPSKKPMFTLEERVALAQQATAHLGNVEVVGFSDLMANFARNQHATVLIRGLRAVADFEYEMQLAHMNRHLMPELESVFLMPSKEWSFISSSLVKEVARHQGDVTHFLPENVHQALMAKLAVD

SEQ ID NO: 35 - protein, 466 aa, Artificial Sequence
  Recombinant Glutamate Synthase
EHVLTMLNEHEVKFVDLRFTDTKGKEQHVTIPAHQVNAEFFEEGKMFDGSSIGGWKGINESDMVLMPDASTAVIDPFFADSTLIIRCDILEPGTLQGYDRDPRSIAKRAEDYLRATGIADTVLFGPEPEFFLFDDIRFGASISGSHVAIDDIEGAWNSSTKYEGGNKGHRPGVKGGYFPVPPVDSAQDIRSEMCLVMEQMGLVVEAHHHEVATAGQNEVATRFNTMTKKADEIQIYKYVVHNVAHRFGKTATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEPMDKNLYDLPPEEAKEIPQVAGSLEEALNALDLDREFLKAGGVFTDEAIDAYIALRREEDDRVRMTPHPVEFELYYSV

SEQ ID NO: 36 - protein, 158 aa, Artificial Sequence
  Recombinant Calcium/calmodulin dependent protein kinase IIa (CaMKIIa), C-terminal fragment
GGKSGGNKKSDGVKESSESTNTAIEDEDTKVRKQEIIKVTEQLIEAISNGDFESYTKMCDPGMTAFEPEALGNLVEGLDFHRFYFENLWSRNSKPVHTTILNPHIHLMGDESACIAYIRITQYLDAGGIPRTAQSEETRVWHRRDGKWQIVHFHRSGA

SEQ ID NO: 37 - protein, 147 aa, Artificial Sequence
  Recombinant Calcium/calmodulin dependent protein kinase IIa (CaMKIIa), C-terminal fragment
GVKESSESTNTAIEDEDTKVRKQEIIKVTEQLIEAISNGDFESYTKMCDPGMTAFEPEALGNLVEGLDFHRFYFENLWSRNSKPVHTTILNPHIHLMGDESACIAYIRITQYLDAGGIPRTAQSEETRVWHRRDGKWQIVHFHRSGA

SEQ ID NO: 38 - protein, 140 aa, Artificial Sequence
  Recombinant Calcium/calmodulin dependent protein kinase IIa (CaMKIIa), C-terminal fragment
STNTAIEDEDTKVRKQEIIKVTEQLIEAISNGDFESYTKMCDPGMTAFEPEALGNLVEGLDFHRFYFENLWSRNSKPVHTTILNPHIHLMGDESACIAYIRITQYLDAGGIPRTAQSEETRVWHRRDGKWQIVHFHRSGA

SEQ ID NO: 39 - protein, 230 aa, Artificial Sequence
  Recombinant HIV capsid oligermerization domain
PIVQNLQGQMVHQAISCLCLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTHNPPIPVGEIYKRWIILGLNKIVRMYSPTSILDIRQGPKEPFRDYVDRFYKTLRAEQASQEVKNAATETLLVQNANPDCKTILKALGPGATLEEMMTACQGVGGPGHKARV

SEQ ID NO: 40 - protein, 217 aa, Artificial Sequence
  Recombinant HIV capsid oligermerization domain
PIVQNLQGQMVHQAISCLCLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTHNPPIPVGEIYKRWIILGLNKIVRMYSPTSILDIRQGPKEPFRDYVDRFYKTLRAEQASQEVKNAATETLLVQNANPDCKTILKALGPGATLEEMMTA

SEQ ID NO: 41 - protein, 18 aa, Artificial Sequence
  recombinant hexamer subunit
PTLYNVSLVMSDTAGTCY

SEQ ID NO: 42 - protein, 27 aa, Artificial Sequence
  T4 fibritin Foldon domain
GYIPEAPRDGQAYVRKDGEWVLLSTFL

SEQ ID NO: 43 - protein, 265 aa, Artificial Sequence [sequence omitted]

SEQ ID NO: 44 - protein, 452 aa, Artificial Sequence
  recombinant tetanus toxin heavy chain C fragment
MKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 45 - protein, 450 aa, Artificial Sequence
  recombinant tetanus toxin heavy chain C fragment
NLDCWVDNEEDIDVILKKSTILNLDINNDIISDISGFNSAVITYPDAQLVPGINGKAIHLVNNEASEVIVHKAMDIEYNDMFNQFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 46 - protein, 450 aa, Artificial Sequence
  recombinant tetanus toxin heavy chain C fragment
NLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTND

SEQ ID NO: 47 - protein, 450 aa, Artificial Sequence
  recombinant tetanus toxin heavy chain C fragment
NLDCWVDKEEDIDVILKKSTILNLDINKDIISDISKFNSAVITYPDAQLVPGINGKAIHLVNNEKSEVIVHKAMKIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTND

SEQ ID NO: 48 - protein, 450 aa, Artificial Sequence
  recombinant tetanus toxin heavy chain C fragment
NLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 49 - protein, 450 aa, Artificial Sequence; identical to SEQ ID NO: 45
  recombinant tetanus toxin heavy chain C fragment

SEQ ID NO: 50 - protein, 450 aa, Artificial Sequence; identical to SEQ ID NO: 46
  recombinant tetanus toxin heavy chain C fragment

SEQ ID NO: 51 - protein, 450 aa, Artificial Sequence; identical to SEQ ID NO: 46
  recombinant tetanus toxin heavy chain C fragment

SEQ ID NO: 52 - protein, 450 aa, Artificial Sequence
  recombinant tetanus toxin heavy chain C fragment
NLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYKNNEHIVGYPKDGNAFNKLDRILRVGYKAPKIPLYKKMEAVKLRDLKTYSVQLKLYDDKQASLGLVGTHNGQIGKDPNRDILIASNWYFNHLKDKILGCDWYFVPTDEGWTND

SEQ ID NO: 53 - protein, 450 aa, Artificial Sequence; identical to SEQ ID NO: 47
  recombinant tetanus toxin heavy chain C fragment

SEQ ID NO: 54 - protein, 450 aa, Artificial Sequence
  recombinant tetanus toxin heavy chain C fragment
NLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHKKSIGSGWSVSLKGNNLIWTLKDSKGEVRQITFRDLPKKFNAYLANKWVFITITNDRKSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTND

SEQ ID NO: 55 - protein, 450 aa, Artificial Sequence
  recombinant tetanus toxin heavy chain C fragment
NLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITKLGAIREDNQITLKLDRCKNNNQYVSIDKFRIFCKALNPKEIEKLYTSYLSITFLRDFWGNPLRYDTEYYLIPVASSSKDVQLKQITDYMYLTKAPSYTNGKLNIYYRRLYNGLKFIIKRYKPNNKIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTND

SEQ ID NO: 56 - protein, 450 aa, Artificial Sequence
  recombinant tetanus toxin heavy chain C fragment
NLDCWVDKEEDIDVILKKSTILNLDINKDIISDISKFNSAVITYPDAQLVPGINGKAIHLVNNEKSEVIVHKAMKIEYNDMFNNFTVSFWLRVPKVSASHLEQYGTNEYSIISSMKKHKKSIGSGWSVSLKGNNLIWTLKDSKGEVRQITFRDLPKKFNAYLANKWVFITITNDRKSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTND

SEQ ID NO: 57 - protein, 450 aa, Artificial Sequence
  recombinant tetanus toxin heavy chain C fragment
NLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITKLGAIREDNQITLKLDRCKNNNQYVSIDKFRIFCKALNPKEIEKLYTSYLSITFLRDFWGNPLRYDTEYYLIPVASSSKDVQLKQITDYMYLTKAPSYTNGKLNIYYRRLYNGLKFIIKRYKPNNKIDSFVKSGDFIKLYVSYKNNEHIVGYPKDGNAFNKLDRILRVGYKAPKIPLYKKMEAVKLRDLKTYSVQLKLYDDKQASLGLVGTHNGQIGKDPNRDILIASNWYFNHLKDKILGCDWYFVPTDEGWTND

SEQ ID NO: 58 - protein, 450 aa, Artificial Sequence
  recombinant tetanus toxin heavy chain C fragment
NLDCWVDKEEDIDVILKKSTILNLDINKDIISDISKFNSAVITYPDAQLVPGINGKAIHLVNNEKSEVIVHKAMKIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITKLGAIREDNQITLKLDRCKNNNQYVSIDKFRIFCKALNPKEIEKLYTSYLSITFLRDFWGNPLRYDTEYYLIPVASSSKDVQLKQITDYMYLTKAPSYTNGKLNIYYRRLYNGLKFIIKRYKPNNKIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTND

SEQ ID NO: 59 - protein, 450 aa, Artificial Sequence
  recombinant tetanus toxin heavy chain C fragment
NLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHKKSIGSGWSVSLKGNNLIWTLKDSKGEVRQITFRDLPKKFNAYLANKWVFITITNDRKSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYKNNEHIVGYPKDGNAFNKLDRILRVGYKAPKIPLYKKMEAVKLRDLKTYSVQLKLYDDKQASLGLVGTHNGQIGKDPNRDILIASNWYFNHLKDKILGCDWYFVPTDEGWTND

SEQ ID NO: 60 - protein, 450 aa, Artificial Sequence
  recombinant tetanus toxin heavy chain C fragment
NLDCWVDKEEDIDVILKKSTILNLDINKDIISDISKFNSAVITYPDAQLVPGINGKAIHLVNNEKSEVIVHKAMKIEYNDMFNNFTVSFWLRVPKVSASHLEQYGTNEYSIISSMKKHKKSIGSGWSVSLKGNNLIWTLKDSKGEVRQITFRDLPKKFNAYLANKWVFITITNDRKSSANLYINGVLMGSAEITKLGAIREDNQITLKLDRCKNNNQYVSIDKFRIFCKALNPKEIEKLYTSYLSITFLRDFWGNPLRYDTEYYLIPVASSSKDVQLKQITDYMYLTKAPSYTNGKLNIYYRRLYNGLKFIIKRYKPNNKIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTND

SEQ ID NO: 61 - protein, 450 aa, Artificial Sequence
  recombinant tetanus toxin heavy chain C fragment
NLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHKKSIGSGWSVSLKGNNLIWTLKDSKGEVRQITFRDLPKKFNAYLANKWVFITITNDRKSSANLYINGVLMGSAEITKLGAIREDNQITLKLDRCKNNNQYVSIDKFRIFCKALNPKEIEKLYTSYLSITFLRDFWGNPLRYDTEYYLIPVASSSKDVQLKQITDYMYLTKAPSYTNGKLNIYYRRLYNGLKFIIKRYKPNNKIDSFVKSGDFIKLYVSYKNNEHIVGYPKDGNAFNKLDRILRVGYKAPKIPLYKKMEAVKLRDLKTYSVQLKLYDDKQASLGLVGTHNGQIGKDPNRDILIASNWYFNHLKDKILGCDWYFVPTDEGWTND

SEQ ID NO: 62 - protein, 450 aa, Artificial Sequence
  recombinant tetanus toxin heavy chain C fragment
NLDCWVDKEEDIDVILKKSTILNLDINKDIISDISKFNSAVITYPDAQLVPGINGKAIHLVNNEKSEVIVHKAMKIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITKLGAIREDNQITLKLDRCKNNNQYVSIDKFRIFCKALNPKEIEKLYTSYLSITFLRDFWGNPLRYDTEYYLIPVASSSKDVQLKQITDYMYLTKAPSYTNGKLNIYYRRLYNGLKFIIKRYKPNNKIDSFVKSGDFIKLYVSYKNNEHIVGYPKDGNAFNKLDRILRVGYKAPKIPLYKKMEAVKLRDLKTYSVQLKLYDDKQASLGLVGTHNGQIGKDPNRDILIASNWYFNHLKDKILGCDWYFVPTDEGWTND

SEQ ID NO: 63 - protein, 450 aa, Artificial Sequence
  recombinant tetanus toxin heavy chain C fragment
NLDCWVDKEEDIDVILKKSTILNLDINKDIISDISKFNSAVITYPDAQLVPGINGKAIHLVNNEKSEVIVHKAMKIEYNDMFNNFTVSFWLRVPKVSASHLEQYGTNEYSIISSMKKHKKSIGSGWSVSLKGNNLIWTLKDSKGEVRQITFRDLPKKFNAYLANKWVFITITNDRKSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYKNNEHIVGYPKDGNAFNKLDRILRVGYKAPKIPLYKKMEAVKLRDLKTYSVQLKLYDDKQASLGLVGTHNGQIGKDPNRDILIASNWYFNHLKDKILGCDWYFVPTDEGWTND

SEQ ID NO: 64 - protein, 247 aa, Artificial Sequence
  recombinant tetanus toxin heavy chain C fragment
NLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSIT

SEQ ID NO: 65 - protein, 341 aa, Artificial Sequence
  recombinant H influenzae protein D protein
SNMANTQMKSDKIIIAHRGASGYLPEHTLESKALAFAQQADYLEQDLAMTKDGRLVVIHDHFLDGLTDVAKKFPHRHRKDGRYYVIDFTLKEIQSLEMTENFETKDGKQAQVYPNRFPLWKSHFRIHTFEDEIEFIQGLEKSTGKKVGIYPEIKAPWFHHQNGKDIAAETLKVLKKYGYDKKTDMVYLQTFDFNELKRIKTELLPQMGMDLKLVQLIAYTDWKETQEKDPKGYWVNYNYDWMFKPGAMAEVVKYADGVGPGWYMLVNKEESKPDNIVYTPLVKELAQYNVEVHPYTVRKDALPEFFTDVNQMYDALLNKSGATGVFTDFPDTGVEFLKGIK

SEQ ID NO: 66 - protein, 535 aa, Artificial Sequence
  Recombinant diphtheria toxin variant CRM197
GADDVVDSSKSFVMENFSSYHGTKPGYVDSIQKGIQKPKSGTQGNYDDDWKEFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKTQPFLHDGYAVSWNTVEDSIIRTGFQGESGHDIKITAENTPLPIAGVLLPTIPGKLDVNKSKTHISVNGRKIRMRCRAIDGDVTFCRPKSPVYVGNGVHANLHVAFHRSSSEKIHSNEISSDSIGVLGYQKTVDHTKVNSKLSLFFEIKS

SEQ ID NO: 67 - protein, 535 aa, Artificial Sequence
  Recombinant diphtheria toxin variant CRM197
GADDVVDSSKSFVMENFASYHGTKPGYVDSIQKGIQKPKSGTQGNYDDDWKEFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKAVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKTQPFLHDGYAVSWNTVEDSIIRTGFQGESGHDIKITAENTPLPIAGVLLPTIPGKLDVNKAKTHISVNGRKIRMRCRAIDGDVTFCRPKSPVYVGNGVHANLHVAFHRSSSEKIHSNEISSDSIGVLGYQKTVDHTKVNSKLSLFFEIKS

SEQ ID NO: 68 - protein, 15 aa, Artificial Sequence
  Protein nanoparticle subunit carrier fusion
QYIKANSKFIGITEL

SEQ ID NO: 69 - protein, 31 aa, Artificial Sequence
  Protein nanoparticle subunit carrier fusion
ILMQYIKANSKFIGKVSVRQSIALSSLMVAQ

SEQ ID NO: 70 - protein, 15 aa, Artificial Sequence
  Protein nanoparticle subunit carrier fusion
AENLWVTVYYGVPVW

SEQ ID NO: 71 - protein, 15 aa, Artificial Sequence
  Protein nanoparticle subunit carrier fusion
TEKLWVTVYYGVPVW

SEQ ID NO: 72 - protein, 708 aa, Artificial Sequence
  Protein nanoparticle subunit carrier fusion
QIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPITFGVITADTLEQAIERAGTKHGNKGWEAALSAIEMANLFKSLRGGKSGGNKKSDGVKESSESGGADDVVDSSKSFVMENFSSYHGTKPGYVDSIQKGIQKPKSGTQGNYDDDWKEFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKTQPFLHDGYAVSWNTVEDSIIRTGFQGESGHDIKITAENTPLPIAGVLLPTIPGKLDVNKSKTHISVNGRKIRMRCRAIDGDVTFCRPKSPVYVGNGVHANLHVAFHRSSSEKIHSNEISSDSIGVLGYQKTVDHTKVNSKLSLFFEIKS

SEQ ID NO: 73 - protein, 625 aa, Artificial Sequence
  Protein nanoparticle subunit carrier fusion
QIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPITFGVITADTLEQAIERAGTKHGNKGWEAALSAIEMANLFKSLRGGKSGGNKKSDGVKESSESGMKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 74 - protein, 514 aa, Artificial Sequence
  Protein nanoparticle subunit carrier fusion
QIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPITFGVITADTLEQAIERAGTKHGNKGWEAALSAIEMANLFKSLRGGKSGGNKKSDGVKESSESGSNMANTQMKSDKIIIAHRGASGYLPEHTLESKALAFAQQADYLEQDLAMTKDGRLVVIHDHFLDGLTDVAKKFPHRHRKDGRYYVIDFTLKEIQSLEMTENFETKDGKQAQVYPNRFPLWKSHFRIHTFEDEIEFIQGLEKSTGKKVGIYPEIKAPWFHHQNGKDIAAETLKVLKKYGYDKKTDMVYLQTFDFNELKRIKTELLPQMGMDLKLVQLIAYTDWKETQEKDPKGYWVNYNYDWMFKPGAMAEVVKYADGVGPGWYMLVNKEESKPDNIVYTPLVKELAQYNVEVHPYTVRKDALPEFFTDVNQMYDALLNKSGATGVFTDFPDTGVEFLKGIK

SEQ ID NO: 75 - protein, 730 aa, Artificial Sequence
  Protein nanoparticle subunit carrier fusion
QIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPITFGVITADTLEQAIERAGTKHGNKGWEAALSAIEMANLFKSLRSLVRAKFVAAWTLKAAAGSLVRAENLWVTVYYGVPVWSLVRGGADDVVDSSKSFVMENFSSYHGTKPGYVDSIQKGIQKPKSGTQGNYDDDWKEFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKTQPFLHDGYAVSWNTVEDSIIRTGFQGESGHDIKITAENTPLPIAGVLLPTIPGKLDVNKSKTHISVNGRKIRMRCRAIDGDVTFCRPKSPVYVGNGVHANLHVAFHRSSSEKIHSNEISSDSIGVLGYQKTVDHTKVNSKLSLFFEIKS

SEQ ID NO: 76 - protein, 651 aa, Artificial Sequence
  Protein nanoparticle subunit carrier fusion
QIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPITFGVITADTLEQAIERAGTKHGNKGWEAALSAIEMANLFKSLRSLVRSLVRAKFVAAWTLKAAAGSLVRAENLWVTVYYGVPVWSLVRGMKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 77 - protein, 540 aa, Artificial Sequence
  Protein nanoparticle subunit carrier fusion
QIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPITFGVITADTLEQAIERAGTKHGNKGWEAALSAIEMANLFKSLRSLVRSLVRAKFVAAWTLKAAAGSLVRAENLWVTVYYGVPVWSLVRGSNMANTQMKSDKIIIAHRGASGYLPEHTLESKALAFAQQADYLEQDLAMTKDGRLVVIHDHFLDGLTDVAKKFPHRHRKDGRYYVIDFTLKEIQSLEMTENFETKDGKQAQVYPNRFPLWKSHFRIHTFEDEIEFIQGLEKSTGKKVGIYPEIKAPWFHHQNGKDIAAETLKVLKKYGYDKKTDMVYLQTFDFNELKRIKTELLPQMGMDLKLVQLIAYTDWKETQEKDPKGYWVNYNYDWMFKPGAMAEVVKYADGVGPGWYMLVNKEESKPDNIVYTPLVKELAQYNVEVHPYTVRKDALPEFFTDVNQMYDALLNKSGATGVFTDFPDTGVEFLKGIK

SEQ ID NO: 78 - protein, 618 aa, Artificial Sequence
  Protein nanoparticle subunit carrier fusion
MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDGGGSGGGSGGGSMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 79 - protein, 616 aa, Artificial Sequence
  Protein nanoparticle subunit carrier fusion
QIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLRGGSGGGSGGGQMKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTND

SEQ ID NO: 80 - protein, 657 aa, Artificial Sequence
  Protein nanoparticle subunit carrier fusion
MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDGGGGSAEAAAKEAAAKAGGGGSGGGGSGGGGSGGGGSGGGGSGGGGSGGGGMQIYEGKLTAEGLRFGIVASRFNHALVDRLVEGCIDCIVRHGGREEDITLVRVPGSWEIPVAAGELARKEDIDAVIAIGVLIRGATPHFDYIASEVSKGLANLSLELRKPITFGVITADTLEQAIERAGTKHGNKCWEAALSAIEMANLFKSLR

SEQ ID NO: 81 - protein, 652 aa, Artificial Sequence
  Protein nanoparticle subunit carrier fusion
MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDAEAAAKEAAAKEAAAKEAAAKALEAEAAAKEAAAKEAAAKEAAAKAMQIYEGKLTAEGLRFGIVASRFNHALVDRLVEGCIDCIVRHGGREEDITLVRVPGSWEIPVAAGELARKEDIDAVIAIGVLIRGATPHFDYIASEVSKGLANLSLELRKPITFGVITADTLEQAIERAGTKHGNKCWEAALSAIEMANLFKSLR

SEQ ID NO: 82 - protein, 635 aa, Artificial Sequence
  Protein nanoparticle subunit carrier fusion
MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDGSAPAPAPAPAPAPAPAPAPAPAPAPASGMQIYEGKLTAEGLRFGIVASRFNHALVDRLVEGCIDCIVRHGGREEDITLVRVPGSWEIPVAAGELARKEDIDAVIAIGVLIRGATPHFDYIASEVSKGLANLSLELRKPITFGVITADTLEQAIERAGTKHGNKCWEAALSAIEMANLFKSLR

SEQ ID NO: 83 - protein, 626 aa, Artificial Sequence
  Protein nanoparticle subunit carrier fusion
MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDAPAPAPAPAPAPAPAPAPAPMQIYEGKLTAEGLRFGIVASRFNHALVDRLVEGCIDCIVRHGGREEDITLVRVPGSWEIPVAAGELARKEDIDAVIAIGVLIRGATPHFDYIASEVSKGLANLSLELRKPITFGVITADTLEQAIERAGTKHGNKCWEAALSAIEMANLFKSLR

SEQ ID NO: 84 - protein, 624 aa, Artificial Sequence
  Protein nanoparticle subunit carrier fusion
MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDAEAAAKEAAAKAGSGSGSMQIYEGKLTAEGLRFGIVASRFNHALVDRLVEGCIDCIVRHGGREEDITLVRVPGSWEIPVAAGELARKEDIDAVIAIGVLIRGATPHFDYIASEVSKGLANLSLELRKPITFGVITADTLEQAIERAGTKHGNKCWEAALSAIEMANLFKSLR

SEQ ID NO: 85 - protein, 621 aa, Artificial Sequence
  Protein nanoparticle subunit carrier fusion
MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDGGGGSGGGGSGGGGSMQIYEGKLTAEGLRFGIVASRFNHALVDRLVEGCIDCIVRHGGREEDITLVRVPGSWEIPVAAGELARKEDIDAVIAIGVLIRGATPHFDYIASEVSKGLANLSLELRKPITFGVITADTLEQAIERAGTKHGNKCWEAALSAIEMANLFKSLR

SEQ ID NO: 86 - protein, 619 aa, Artificial Sequence
  Protein nanoparticle subunit carrier fusion
MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDGSGSGSGSGSASGMQIYEGKLTAEGLRFGIVASRFNHALVDRLVEGCIDCIVRHGGREEDITLVRVPGSWEIPVAAGELARKEDIDAVIAIGVLIRGATPHFDYIASEVSKGLANLSLELRKPITFGVITADTLEQAIERAGTKHGNKCWEAALSAIEMANLFKSLR

SEQ ID NO: 87 - protein, 617 aa, Artificial Sequence
  Protein nanoparticle subunit carrier fusion
MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDAPAPAPGGGGSMQIYEGKLTAEGLRFGIVASRFNHALVDRLVEGCIDCIVRHGGREEDITLVRVPGSWEIPVAAGELARKEDIDAVIAIGVLIRGATPHFDYIASEVSKGLANLSLELRKPITFGVITADTLEQAIERAGTKHGNKCWEAALSAIEMANLFKSLR

SEQ ID NO: 88 - protein, 652 aa, Artificial Sequence
  Protein nanoparticle subunit carrier fusion
MQIYEGKLTAEGLRFGIVASRFNHALVDRLVEGCIDCIVRHGGREEDITLVRVPGSWEIPVAAGELARKEDIDAVIAIGVLIRGATPHFDYIASEVSKGLANLSLELRKPITFGVITADTLEQAIERAGTKHGNKCWEAALSAIEMANLFKSLRAEAAAKEAAAKEAAAKEAAAKALEAEAAAKEAAAKEAAAKEAAAKAMKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTND

SEQ ID NO: 89 - protein, 648 aa, Artificial Sequence
  Protein nanoparticle subunit carrier fusion
MQIYEGKLTAEGLRFGIVASRFNHALVDRLVEGCIDCIVRHGGREEDITLVRVPGSWEIPVAAGELARKEDIDAVIAIGVLIRGATPHFDYIASEVSKGLANLSLELRKPITFGVITADTLEQAIERAGTKHGNKCWEAALSAIEMANLFKSLRGGGGSGGGGSGGGGSGGGGSGGGGSAEAAAKEAAAKAGGGGSMKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTND

SEQ ID NO: 90 - protein, 642 aa, Artificial Sequence
  Protein nanoparticle subunit carrier fusion
MQIYEGKLTAEGLRFGIVASRFNHALVDRLVEGCIDCIVRHGGREEDITLVRVPGSWEIPVAAGELARKEDIDAVIAIGVLIRGATPHFDYIASEVSKGLANLSLELRKPITFGVITADTLEQAIERAGTKHGNKCWEAALSAIEMANLFKSLRAEAAAKEAAAKEAAAKALEAEAAAKEAAAKEAAAKAMKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTND

SEQ ID NO: 91 - protein, 635 aa, Artificial Sequence
  Protein nanoparticle subunit carrier fusion
MQIYEGKLTAEGLRFGIVASRFNHALVDRLVEGCIDCIVRHGGREEDITLVRVPGSWEIPVAAGELARKEDIDAVIAIGVLIRGATPHFDYIASEVSKGLANLSLELRKPITFGVITADTLEQAIERAGTKHGNKCWEAALSAIEMANLFKSLRGSAPAPAPAPAPAPAPAPAPAPAPAPASGMKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTND

SEQ ID NO: 92 - protein, 626 aa, Artificial Sequence
  Protein nanoparticle subunit carrier fusion
MQIYEGKLTAEGLRFGIVASRFNHALVDRLVEGCIDCIVRHGGREEDITLVRVPGSWEIPVAAGELARKEDIDAVIAIGVLIRGATPHFDYIASEVSKGLANLSLELRKPITFGVITADTLEQAIERAGTKHGNKCWEAALSAIEMANLFKSLRAPAPAPAPAPAPAPAPAPAPMKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTND

SEQ ID NO: 93 - protein, 623 aa, Artificial Sequence
  Protein nanoparticle subunit carrier fusion
MQIYEGKLTAEGLRFGIVASRFNHALVDRLVEGCIDCIVRHGGREEDITLVRVPGSWEIPVAAGELARKEDIDAVIAIGVLIRGATPHFDYIASEVSKGLANLSLELRKPITFGVITADTLEQAIERAGTKHGNKCWEAALSAIEMANLFKSLRGSGSGAEAAAKEAAAKAMKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTND

SEQ ID NO: 94 - protein, 621 aa, Artificial Sequence
  Protein nanoparticle subunit carrier fusion
MQIYEGKLTAEGLRFGIVASRFNHALVDRLVEGCIDCIVRHGGREEDITLVRVPGSWEIPVAAGELARKEDIDAVIAIGVLIRGATPHFDYIASEVSKGLANLSLELRKPITFGVITADTLEQAIERAGTKHGNKCWEAALSAIEMANLFKSLRGGGGSGGGGSGGGGSMKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTND

SEQ ID NO: 95 - protein, 619 aa, Artificial Sequence
  Protein nanoparticle subunit carrier fusion
MQIYEGKLTAEGLRFGIVASRFNHALVDRLVEGCIDCIVRHGGREEDITLVRVPGSWEIPVAAGELARKEDIDAVIAIGVLIRGATPHFDYIASEVSKGLANLSLELRKPITFGVITADTLEQAIERAGTKHGNKCWEAALSAIEMANLFKSLRGSGSGSGSGSASGMKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTND

SEQ ID NO: 96 - protein, 619 aa, Artificial Sequence
  Protein nanoparticle subunit carrier fusion
MQIYEGKLTAEGLRFGIVASRFNHALVDRLVEGCIDCIVRHGGREEDITLVRVPGSWEIPVAAGELARKEDIDAVIAIGVLIRGATPHFDYIASEVSKGLANLSLELRKPITFGVITADTLEQAIERAGTKHGNKCWEAALSAIEMANLFKSLRGGGGSPAPAPASGMKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTND

SEQ ID NO: 97 - protein, 644 aa, Artificial Sequence
  Protein nanoparticle subunit carrier fusion
MKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTNDSGSAGKKGSSQYIKANSKFIGITELMQIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPITFGVITADTLEQAIERAGTKHGNKGWEAALSAIEMANLFKSLRAKFVAAWTLKAAA

SEQ ID NO: 98 - protein, 623 aa, Artificial Sequence
  Protein nanoparticle subunit carrier fusion
MKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTNDSGSAMQIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPITFGVITADTLEQAIERAGTKHGNKGWEAALSAIEMANLFKSLRAKFVAAWTLKAAA

SEQ ID NO: 99 - protein, 619 aa, Artificial Sequence
  Protein nanoparticle subunit carrier fusion
MKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTNDSGSAKALEAQKQKMQIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPITFGVITADTLEQAIERAGTKHGNKGWEAALSAIEMANLFKSLR

SEQ ID NO: 100 - protein, 619 aa, Artificial Sequence
  Protein nanoparticle subunit carrier fusion
MQIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPITFGVITADTLEQAIERAGTKHGNKGWEAALSAIEMANLFKSLRSGSAKALEAQKQKMKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 101 - protein, 749 aa, Artificial Sequence
  Protein nanoparticle subunit carrier fusion
MKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITTTMLATRNFSGGKSGGNKKSDGVKESSESTNTTIEDEDMQIYEGKLTAEGLRFGIVASRFNHALVDRLVEGAIDAIVRHGGREEDITLVRVPGSWEIPVAAGELARKENISAVIAIGVLIRGLEVLFQGPGAKFVAAWTLKAAAGDEVDATPHFDYIASEVSKGLADLSLELRKPITFGVITADTLEQAIERAGTKHGNKGWEAALSAIEMANLFKSLRGGKSGGNKKSDGVNLTDLGLTQSNIQKLDIDITEGDNAGVQITLTNDQALVKVGNFQTQGSVRDIENLRQTIEAQISDLDSQSNTSNASQVALERVRQLNNNIENLAGETTQAISIGDNANRSAQTLGKINATFRNAIAQGAADDKASNIRLGSSLREIATGLASQSKNLNNQTLLSLSNTNIVQAGSGSARLLSLVNQPVQNAQALVSTGAQQLIQARSMNSVETAYDSDEIRSRASTLNNVTNGLNTIASNFRNQVAGLDSRLTDVQALAADIKQLPNE

SEQ ID NO: 102 - protein, 749 aa, Artificial Sequence
  Protein nanoparticle subunit carrier fusion
MKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITTTMLATRNFSGGKSGGNKKSDGVKESSESTNTTIEDEDMQIYEGKLTAEGLRFGIVASRFNHALVDRLVEGAIDAIVRHGGREEDITLVRVPGSWEIPVAAGELARKENISAVIAIGVLIRGLEVLFQGPGAKFVAAWTLKAAAGDEVDATPHFDYIASEVSKGLADLSLELRKPITFGVITADTLEQAIERAGTKHGNKGWEAALSAIEMANLFKSLRGGKSGGNKKSDGVNLADLGLTQSNIQKLDIDITEGDNAGVQITLTNDQALVKVGNFQTQGSVRDIENLRQTIEAQISDLDSQSNTSNAAQVALERVRQLNNNIENLAGETTQAISIGDNANRAAQTLGKINAAFRNAIAQGAADDKASNIRLGSSLREIATGLASQSKNLNNQALLSLSNTNIVQAGSGSARLLSLVNQPVQNAQALVSTGAQQLIQARSMNSVETAYDSDEIRSRASTLNNVANGLNTIASNFRNQVAGLDSRLTDVQALAADIKQLPNE

SEQ ID NO: 103 - protein, 749 aa, Artificial Sequence
  Protein nanoparticle subunit carrier fusion
MKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITTTMLATRNFSGGKSGGNKKSDGVKESSESTNTTIEDEDMQIYEGKLTAEGLRFGIVASRFNHALVDRLVEGAIDAIVRHGGREEDITLVRVPGSWEIPVAAGELARKENISAVIAIGVLIRGLEVLFQGPGAKFVAAWTLKAAAGDEVDATPHFDYIASEVSKGLADLSLELRKPITFGVITADTLEQAIERAGTKHGNKGWEAALSAIEMANLFKSLRGGKSGGNKKSDGVENPLQKIDAALAQVDTLRSDLGAVQNRFNSAITNLGNTVNNLTSARSRIEDSDYATEVSNMSRAQILQQAGTSVLAQANQVPQNVLSLLRGSGSAAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDTLN

SEQ ID NO: 104 - protein, 752 aa, Artificial Sequence
  Protein nanoparticle subunit carrier fusion
MKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITTTMLATRNFSGGKSGGNKKSDGVKESSESTNTTIEDEDGSGMQIYEGKLTAEGLRFGIVASRFNHALVDRLVEGAIDAIVRHGGREEDITLVRVPGSWEIPVAAGELARKENISAVIAIGVLIRGLEVLFQGPGAKFVAAWTLKAAAGDEVDATPHFDYIASEVSKGLADLSLELRKPITFGVITADTLEQAIERAGTKHGNKGWEAALSAIEMANLFKSLRGGKSGGNKKSDGVENPLQKIDAALAQVDTLRSDLGAVQNRFNSAITNLGNTVNNLASARSRIEDSDYATEVSNMARAQILQQAGTSVLAQANQVPQNVLSLLRGSGSAAQVINTNSLSLLTQNNLNKAQSALGTAIERLSSGLRINSAKDDAAGQAIANRFTANIKGLTQASRNANDGISIAQTTEGALNEINNNLQRVRELAVQSANSANSQSDLDSIQAEITQRLNEIDRVSGQTQFNGVKVLAQDNTLTIQVGANDGETIDIDLKQINSQTLGLDTLN

SEQ ID NO: 105 - protein, 749 aa, Artificial Sequence
  Protein nanoparticle subunit carrier fusion
NLTDLGLTQSNIQKLDIDITEGDNAGVQITLTNDQALVKVGNFQTQGSVRDIENLRQTIEAQISDLDSQSNTSNASQVALERVRQLNNNIENLAGETTQAISIGDNANRSAQTLGKINATFRNAIAQGAADDKASNIRLGSSLREIATGLASQSKNLNNQTLLSLSNTNIVQAGSGSARLLSLVNQPVQNAQALVSTGAQQLIQARSMNSVETAYDSDEIRSRASTLNNVTNGLNTIASNFRNQVAGLDSRLTDVQALAADIKQLPNEGGKSGGNKKSDGVMQIYEGKLTAEGLRFGIVASRFNHALVDRLVEGAIDAIVRHGGREEDITLVRVPGSWEIPVAAGELARKENISAVIAIGVLIRGLEVLFQGPGAKFVAAWTLKAAAGDEVDATPHFDYIASEVSKGLADLSLELRKPITFGVITADTLEQAIERAGTKHGNKGWEAALSAIEMANLFKSLRTTMLATRNFSGGKSGGNKKSDGVKESSESTNTTIEDEDMKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSIT

SEQ ID NO: 106 - protein, 752 aa, Artificial Sequence
  Protein nanoparticle subunit carrier fusion
NLADLGLTQSNIQKLDIDITEGDNAGVQITLTNDQALVKVGNFQTQGSVRDIENLRQTIEAQISDLDSQSNTSNAAQVALERVRQLNNNIENLAGETTQAISIGDNANRAAQTLGKINAAFRNAIAQGAADDKASNIRLGSSLREIATGLASQSKNLNNQALLSLSNTNIVQAGSGSARLLSLVNQPVQNAQALVSTGAQQLIQARSMNSVETAYDSDEIRSRASTLNNVANGLNTIASNFRNQVAGLDSRLTDVQALAADIKQLPNEGGKSGGNKKSDGVGSGMQIYEGKLTAEGLRFGIVASRFNHALVDRLVEGAIDAIVRHGGREEDITLVRVPGSWEIPVAAGELARKENISAVIAIGVLIRGLEVLFQGPGAKFVAAWTLKAAAGDEVDATPHFDYIASEVSKGLADLSLELRKPITFGVITADTLEQAIERAGTKHGNKGWEAALSAIEMANLFKSLRTTMLATRNFSGGKSGGNKKSDGVKESSESTNTTIEDEDMKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSIT

SEQ ID NO: 107 - protein, 749 aa, Artificial Sequence
  Protein nanoparticle subunit carrier fusion
ENPLQKIDAALAQVDTLRSDLGAVQNRFNSAITNLGNTVNNLTSARSRIEDSDYATEVSNMSRAQILQQAGTSVLAQANQVPQNVLSLLRGSGSAAQVINTNSLSLLTQNNLNKSQSALGTAIERLSSGLRINSAKDDAAGQAIANRFTANIKGLTQASRNANDGISIAQTTEGALNEINNNLQRVRELAVQSANSTNSQSDLDSIQAEITQRLNEIDRVSGQTQFNGVKVLAQDNTLTIQVGANDGETIDIDLKQINSQTLGLDTLNGGKSGGNKKSDGVMQIYEGKLTAEGLRFGIVASRFNHALVDRLVEGAIDAIVRHGGREEDITLVRVPGSWEIPVAAGELARKENISAVIAIGVLIRGLEVLFQGPGAKFVAAWTLKAAAGDEVDATPHFDYIASEVSKGLADLSLELRKPITFGVITADTLEQAIERAGTKHGNKGWEAALSAIEMANLFKSLRTTMLATRNFSGGKSGGNKKSDGVKESSESTNTTIEDEDMKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSIT

SEQ ID NO: 108 - protein, 754 aa, Artificial Sequence
  Protein nanoparticle subunit carrier fusion
ENPLQKIDAALAQVDTLRSDLGAVQNRFNSAITNLGNTVNNLASARSRIEDSDYATEVSNMARAQILQQAGTSVLAQANQVPQNVLSLLRGSGSAAQVINTNSLSLLTQNNLNKAQSALGTAIERLSSGLRINSAKDDAAGQAIANRFTANIKGLTQASRNANDGISIAQTTEGALNEINNNLQRVRELAVQSANSANSQSDLDSIQAEITQRLNEIDRVSGQTQFNGVKVLAQDNTLTIQVGANDGETIDIDLKQINSQTLGLDTLNGGKSGGNKKSDGVGSGMQIYEGKLTAEGLRFGIVASRFNHALVDRLVEGAIDAIVRHGGREEDITLVRVPGSWEIPVAAGELARKENISAVIAIGVLIRGLEVLFQGPGAKFVAAWTLKAAAGDEVDATPHFDYIASEVSKGLADLSLELRKPITFGVITADTLEQAIERAGTKHGNKGWEAALSAIEMANLFKSLRGGTTMLATRNFSGGKSGGNKKSDGVKESSESTNTTIEDEDMKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSIT

SEQ ID NO: 109 - protein, 631 aa, Artificial Sequence
  Protein nanoparticle subunit carrier fusion
NLDCWVDNEEDIDVILKKSTILNLDINNDIISDISGFNSAVITYPDAQLVPGINGKAIHLVNNEASEVIVHKAMDIEYNDMFNQFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTNDGGSGGGSGGASISEKMVEALNRQINAEIYSAYLYLSMASYFDSIGLKGFSNWMRVQWQEELMHAMKMFDFVSRRGGRVKLYAVEEPPSEWDSPLAAFEHVYEHEVNVVKRIHELVEMAMQEKDFATYNFLQWYVAEQVEEEASALDIVEKLRLIGEDKRALLFLDKELSLRQFTPPAEEEK

SEQ ID NO: 110 - protein, 637 aa, Artificial Sequence
  Protein nanoparticle subunit carrier fusion
NLDCWVDNEEDIDVILKKSTILNLDINNDIISDISGFNSAVITYPDAQLVPGINGKAIHLVNNEASEVIVHKAMDIEYNDMFNQFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTNDGGSGGGSGGGSGGSGASISEKMVEALNRQINAEIYSAYLYLSMASYFDSIGLKGFSNWMRVQWQEELMHAMKMFDFVSRRGGRVKLYAVEEPPSEWDSPLAAFEHVYEHEVNVVKRIHELVEMAMQEKDFATYNFLQWYVAEQVEEEASALDIVEKLRLIGEDKRALLFLDKELSLRQFTPPAEEEK

SEQ ID NO: 111 - protein, 637 aa, Artificial Sequence
  Protein nanoparticle subunit carrier fusion
NLDCWVDNEEDIDVILKKSTILNLDINNDIISDISGFNSAVITYPDAQLVPGINGKAIHLVNNEASEVIVHKAMDIEYNDMFNQFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTNDGGDGGGDGGGDGGDGASISEKMVEALNRQINAEIYSAYLYLSMASYFDSIGLKGFSNWMRVQWQEELMHAMKMFDFVSRRGGRVKLYAVEEPPSEWDSPLAAFEHVYEHEVNVVKRIHELVEMAMQEKDFATYNFLQWYVAEQVEEEASALDIVEKLRLIGEDKRALLFLDKELSLRQFTPPAEEEK

SEQ ID NO: 112 - protein, 626 aa, Artificial Sequence
  Protein nanoparticle subunit carrier fusion
NLDCWVDNEEDIDVILKKSTILNLDINNDIISDISGFNSAVITYPDAQLVPGINGKAIHLVNNEASEVIVHKAMDIEYNDMFNQFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTNDGGSGGGSGGMLSKDIIKLLNEQVNKEMDSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 113 - protein, 632 aa, Artificial Sequence
  Protein nanoparticle subunit carrier fusion
NLDCWVDNEEDIDVILKKSTILNLDINNDIISDISGFNSAVITYPDAQLVPGINGKAIHLVNNEASEVIVHKAMDIEYNDMFNQFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTNDGGSGGGSGGGSGGSGMLSKDIIKLLNEQVNKEMDSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 114 - protein, 632 aa, Artificial Sequence
  Protein nanoparticle subunit carrier fusion
NLDCWVDNEEDIDVILKKSTILNLDINNDIISDISGFNSAVITYPDAQLVPGINGKAIHLVNNEASEVIVHKAMDIEYNDMFNQFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTNDGGDGGGDGGGDGGDGMLSKDIIKLLNEQVNKEMDSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 115 - protein, 621 aa, Artificial Sequence
  Protein nanoparticle subunit carrier fusion
MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDGGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 116 - protein, 630 aa, Artificial Sequence
  Protein nanoparticle subunit carrier fusion
MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDGGGSGGGGSGGSGGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 117 - protein, 640 aa, Artificial Sequence
  Protein nanoparticle subunit carrier fusion
MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDGGGSGGGGSGGSGGGGSGGGGSGGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 118 - protein, 650 aa, Artificial Sequence
  Protein nanoparticle subunit carrier fusion
MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDGGGSGGGGSGGSGGGGSGGGGSGGGGSGGGGSGGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 119 - protein, 621 aa, Artificial Sequence
  Protein nanoparticle subunit carrier fusion
MKNLDCWVDKEEDIDVILKKSTILNLDINKDIISDISKFNSAVITYPDAQLVPGINGKAIHLVNNEKSEVIVHKAMKIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDGGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 120 - protein, 621 aa, Artificial Sequence
  Protein nanoparticle subunit carrier fusion
MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHKKSIGSGWSVSLKGNNLIWTLKDSKGEVRQITFRDLPKKFNAYLANKWVFITITNDRKSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDGGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 121 - protein, 621 aa, Artificial Sequence
  Protein nanoparticle subunit carrier fusion
MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITKLGAIREDNQITLKLDRCKNNNQYVSIDKFRIFCKALNPKEIEKLYTSYLSITFLRDFWGNPLRYDTEYYLIPVASSSKDVQLKQITDYMYLTKAPSYTNGKLNIYYRRLYNGLKFIIKRYKPNNKIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDGGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 122 - protein, 621 aa, Artificial Sequence
  Protein nanoparticle subunit carrier fusion
MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYKNNEHIVGYPKDGNAFNKLDRILRVGYKAPKIPLYKKMEAVKLRDLKTYSVQLKLYDDKQASLGLVGTHNGQIGKDPNRDILIASNWYFNHLKDKILGCDWYFVPTDEGWTNDGGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 123 - protein, 621 aa, Artificial Sequence
  Protein nanoparticle subunit carrier fusion
MKNLDCWVDKEEDIDVILKKSTILNLDINKDIISDISKFNSAVITYPDAQLVPGINGKAIHLVNNEKSEVIVHKAMKIEYNDMFNNFTVSFWLRVPKVSASHLEQYGTNEYSIISSMKKHKKSIGSGWSVSLKGNNLIWTLKDSKGEVRQITFRDLPKKFNAYLANKWVFITITNDRKSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDGGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 124 - protein, 621 aa, Artificial Sequence
  Protein nanoparticle subunit carrier fusion
MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITKLGAIREDNQITLKLDRCKNNNQYVSIDKFRIFCKALNPKEIEKLYTSYLSITFLRDFWGNPLRYDTEYYLIPVASSSKDVQLKQITDYMYLTKAPSYTNGKLNIYYRRLYNGLKFIIKRYKPNNKIDSFVKSGDFIKLYVSYKNNEHIVGYPKDGNAFNKLDRILRVGYKAPKIPLYKKMEAVKLRDLKTYSVQLKLYDDKQASLGLVGTHNGQIGKDPNRDILIASNWYFNHLKDKILGCDWYFVPTDEGWTNDGGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 125 - protein, 621 aa, Artificial Sequence
  Protein nanoparticle subunit carrier fusion
MKNLDCWVDKEEDIDVILKKSTILNLDINKDIISDISKFNSAVITYPDAQLVPGINGKAIHLVNNEKSEVIVHKAMKIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITKLGAIREDNQITLKLDRCKNNNQYVSIDKFRIFCKALNPKEIEKLYTSYLSITFLRDFWGNPLRYDTEYYLIPVASSSKDVQLKQITDYMYLTKAPSYTNGKLNIYYRRLYNGLKFIIKRYKPNNKIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDGGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 126 - protein, 621 aa, Artificial Sequence
  Protein nanoparticle subunit carrier fusion
MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHKKSIGSGWSVSLKGNNLIWTLKDSKGEVRQITFRDLPKKFNAYLANKWVFITITNDRKSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYKNNEHIVGYPKDGNAFNKLDRILRVGYKAPKIPLYKKMEAVKLRDLKTYSVQLKLYDDKQASLGLVGTHNGQIGKDPNRDILIASNWYFNHLKDKILGCDWYFVPTDEGWTNDGGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 127 - protein, 621 aa, Artificial Sequence
  Protein nanoparticle subunit carrier fusion
MKNLDCWVDKEEDIDVILKKSTILNLDINKDIISDISKFNSAVITYPDAQLVPGINGKAIHLVNNEKSEVIVHKAMKIEYNDMFNNFTVSFWLRVPKVSASHLEQYGTNEYSIISSMKKHKKSIGSGWSVSLKGNNLIWTLKDSKGEVRQITFRDLPKKFNAYLANKWVFITITNDRKSSANLYINGVLMGSAEITKLGAIREDNQITLKLDRCKNNNQYVSIDKFRIFCKALNPKEIEKLYTSYLSITFLRDFWGNPLRYDTEYYLIPVASSSKDVQLKQITDYMYLTKAPSYTNGKLNIYYRRLYNGLKFIIKRYKPNNKIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDGGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 128 - protein, 621 aa, Artificial Sequence
  Protein nanoparticle subunit carrier fusion
MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHKKSIGSGWSVSLKGNNLIWTLKDSKGEVRQITFRDLPKKFNAYLANKWVFITITNDRKSSANLYINGVLMGSAEITKLGAIREDNQITLKLDRCKNNNQYVSIDKFRIFCKALNPKEIEKLYTSYLSITFLRDFWGNPLRYDTEYYLIPVASSSKDVQLKQITDYMYLTKAPSYTNGKLNIYYRRLYNGLKFIIKRYKPNNKIDSFVKSGDFIKLYVSYKNNEHIVGYPKDGNAFNKLDRILRVGYKAPKIPLYKKMEAVKLRDLKTYSVQLKLYDDKQASLGLVGTHNGQIGKDPNRDILIASNWYFNHLKDKILGCDWYFVPTDEGWTNDGGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 129 - protein, 621 aa, Artificial Sequence
  Protein nanoparticle subunit carrier fusion
MKNLDCWVDKEEDIDVILKKSTILNLDINKDIISDISKFNSAVITYPDAQLVPGINGKAIHLVNNEKSEVIVHKAMKIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITKLGAIREDNQITLKLDRCKNNNQYVSIDKFRIFCKALNPKEIEKLYTSYLSITFLRDFWGNPLRYDTEYYLIPVASSSKDVQLKQITDYMYLTKAPSYTNGKLNIYYRRLYNGLKFIIKRYKPNNKIDSFVKSGDFIKLYVSYKNNEHIVGYPKDGNAFNKLDRILRVGYKAPKIPLYKKMEAVKLRDLKTYSVQLKLYDDKQASLGLVGTHNGQIGKDPNRDILIASNWYFNHLKDKILGCDWYFVPTDEGWTNDGGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 130 - protein, 621 aa, Artificial Sequence
  Protein nanoparticle subunit carrier fusion
MKNLDCWVDKEEDIDVILKKSTILNLDINKDIISDISKFNSAVITYPDAQLVPGINGKAIHLVNNEKSEVIVHKAMKIEYNDMFNNFTVSFWLRVPKVSASHLEQYGTNEYSIISSMKKHKKSIGSGWSVSLKGNNLIWTLKDSKGEVRQITFRDLPKKFNAYLANKWVFITITNDRKSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYKNNEHIVGYPKDGNAFNKLDRILRVGYKAPKIPLYKKMEAVKLRDLKTYSVQLKLYDDKQASLGLVGTHNGQIGKDPNRDILIASNWYFNHLKDKILGCDWYFVPTDEGWTNDGGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 131 - protein, 621 aa, Artificial Sequence
  Protein nanoparticle subunit carrier fusion
MKNLDCWVDKEEDIDVILKKSTILNLDINKDIISDISKFNSAVITYPDAQLVPGINGKAIHLVNNEKSEVIVHKAMKIEYNDMFNNFTVSFWLRVPKVSASHLEQYGTNEYSIISSMKKHKKSIGSGWSVSLKGNNLIWTLKDSKGEVRQITFRDLPKKFNAYLANKWVFITITNDRKSSANLYINGVLMGSAEITKLGAIREDNQITLKLDRCKNNNQYVSIDKFRIFCKALNPKEIEKLYTSYLSITFLRDFWGNPLRYDTEYYLIPVASSSKDVQLKQITDYMYLTKAPSYTNGKLNIYYRRLYNGLKFIIKRYKPNNKIDSFVKSGDFIKLYVSYKNNEHIVGYPKDGNAFNKLDRILRVGYKAPKIPLYKKMEAVKLRDLKTYSVQLKLYDDKQASLGLVGTHNGQIGKDPNRDILIASNWYFNHLKDKILGCDWYFVPTDEGWTNDGGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 132 - protein, 630 aa, Artificial Sequence
  Protein nanoparticle subunit carrier fusion
MKNLDCWVDKEEDIDVILKKSTILNLDINKDIISDISKFNSAVITYPDAQLVPGINGKAIHLVNNEKSEVIVHKAMKIEYNDMFNNFTVSFWLRVPKVSASHLEQYGTNEYSIISSMKKHKKSIGSGWSVSLKGNNLIWTLKDSKGEVRQITFRDLPKKFNAYLANKWVFITITNDRKSSANLYINGVLMGSAEITKLGAIREDNQITLKLDRCKNNNQYVSIDKFRIFCKALNPKEIEKLYTSYLSITFLRDFWGNPLRYDTEYYLIPVASSSKDVQLKQITDYMYLTKAPSYTNGKLNIYYRRLYNGLKFIIKRYKPNNKIDSFVKSGDFIKLYVSYKNNEHIVGYPKDGNAFNKLDRILRVGYKAPKIPLYKKMEAVKLRDLKTYSVQLKLYDDKQASLGLVGTHNGQIGKDPNRDILIASNWYFNHLKDKILGCDWYFVPTDEGWTNDGGGSGGGGSGGSGGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 133 - protein, 640 aa, Artificial Sequence
  Protein nanoparticle subunit carrier fusion
MKNLDCWVDKEEDIDVILKKSTILNLDINKDIISDISKFNSAVITYPDAQLVPGINGKAIHLVNNEKSEVIVHKAMKIEYNDMFNNFTVSFWLRVPKVSASHLEQYGTNEYSIISSMKKHKKSIGSGWSVSLKGNNLIWTLKDSKGEVRQITFRDLPKKFNAYLANKWVFITITNDRKSSANLYINGVLMGSAEITKLGAIREDNQITLKLDRCKNNNQYVSIDKFRIFCKALNPKEIEKLYTSYLSITFLRDFWGNPLRYDTEYYLIPVASSSKDVQLKQITDYMYLTKAPSYTNGKLNIYYRRLYNGLKFIIKRYKPNNKIDSFVKSGDFIKLYVSYKNNEHIVGYPKDGNAFNKLDRILRVGYKAPKIPLYKKMEAVKLRDLKTYSVQLKLYDDKQASLGLVGTHNGQIGKDPNRDILIASNWYFNHLKDKILGCDWYFVPTDEGWTNDGGGSGGGGSGGSGGGGSGGGGSGGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 134 - protein, 650 aa, Artificial Sequence
  Protein nanoparticle subunit carrier fusion
MKNLDCWVDKEEDIDVILKKSTILNLDINKDIISDISKFNSAVITYPDAQLVPGINGKAIHLVNNEKSEVIVHKAMKIEYNDMFNNFTVSFWLRVPKVSASHLEQYGTNEYSIISSMKKHKKSIGSGWSVSLKGNNLIWTLKDSKGEVRQITFRDLPKKFNAYLANKWVFITITNDRKSSANLYINGVLMGSAEITKLGAIREDNQITLKLDRCKNNNQYVSIDKFRIFCKALNPKEIEKLYTSYLSITFLRDFWGNPLRYDTEYYLIPVASSSKDVQLKQITDYMYLTKAPSYTNGKLNIYYRRLYNGLKFIIKRYKPNNKIDSFVKSGDFIKLYVSYKNNEHIVGYPKDGNAFNKLDRILRVGYKAPKIPLYKKMEAVKLRDLKTYSVQLKLYDDKQASLGLVGTHNGQIGKDPNRDILIASNWYFNHLKDKILGCDWYFVPTDEGWTNDGGGSGGGGSGGSGGGGSGGGGSGGGGSGGGGSGGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 135 - protein, 663 aa, Artificial Sequence
  Protein nanoparticle subunit carrier fusion
MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDGGAEAAAKEAAAKEAAAKEAAAKALEAEAAAKEAAAKEAAAKEAAAKADIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 136 - protein, 642 aa, Artificial Sequence
  Protein nanoparticle subunit carrier fusion
MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDGSAPAPAPAPAPAPAPAPAPAPAPAPADIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 137 - protein, 634 aa, Artificial Sequence
  Protein nanoparticle subunit carrier fusion
MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDGGAEAAAKEAAAKEAAAKADIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 138 - protein, 630 aa, Artificial Sequence
  Protein nanoparticle subunit carrier fusion
MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDGGGGSGGGGSGGGGSDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 139 - protein, 629 aa, Artificial Sequence
  Protein nanoparticle subunit carrier fusion
MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDGSAEAAAKEAAAKADIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 140 - protein, 628 aa, Artificial Sequence
  Protein nanoparticle subunit carrier fusion
MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDGSGSGSGSGSASGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 141 - protein, 623 aa, Artificial Sequence
  Protein nanoparticle subunit carrier fusion
MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDPAPAPASGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 142 - protein, 602 aa, Artificial Sequence
  Protein nanoparticle subunit carrier fusion
DIIKLLNEQVNKEMNSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGKALEAQKQKMKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 143 - protein, 605 aa, Artificial Sequence
  Protein nanoparticle subunit carrier fusion
DIIKLLNEQVNKEMNSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENKALEAQKQKMKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 144 - protein, 626 aa, Artificial Sequence
  Protein nanoparticle subunit carrier fusion
MKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTNDKALEAQKQKSKDIIKLLNEQVNKEMNSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 145 - protein, 635 aa, Artificial Sequence
  Protein nanoparticle subunit carrier fusion
MKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTNDKALEAQKQKKALEAQKQKSKDIIKLLNEQVNKEMNSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 146 - protein, 685 aa, Artificial Sequence
  Protein nanoparticle subunit carrier fusion
DIIKLLNEQVNKEMNSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGKALEAQKQKGADDVVDSSKSFVMENFSSYHGTKPGYVDSIQKGIQKPKSGTQGNYDDDWKEFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKTQPFLHDGYAVSWNTVEDSIIRTGFQGESGHDIKITAENTPLPIAGVLLPTIPGKLDVNKSKTHISVNGRKIRMRCRAIDGDVTFCRPKSPVYVGNGVHANLHVAFHRSSSEKIHSNEISSDSIGVLGYQKTVDHTKVNSKLSLFFEIKS

SEQ ID NO: 147 - protein, 688 aa, Artificial Sequence
  Protein nanoparticle subunit carrier fusion
DIIKLLNEQVNKEMNSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENKALEAQKQKGADDVVDSSKSFVMENFSSYHGTKPGYVDSIQKGIQKPKSGTQGNYDDDWKEFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKTQPFLHDGYAVSWNTVEDSIIRTGFQGESGHDIKITAENTPLPIAGVLLPTIPGKLDVNKSKTHISVNGRKIRMRCRAIDGDVTFCRPKSPVYVGNGVHANLHVAFHRSSSEKIHSNEISSDSIGVLGYQKTVDHTKVNSKLSLFFEIKS

SEQ ID NO: 148 - protein, 709 aa, Artificial Sequence
  Protein nanoparticle subunit carrier fusion
GADDVVDSSKSFVMENFSSYHGTKPGYVDSIQKGIQKPKSGTQGNYDDDWKEFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKTQPFLHDGYAVSWNTVEDSIIRTGFQGESGHDIKITAENTPLPIAGVLLPTIPGKLDVNKSKTHISVNGRKIRMRCRAIDGDVTFCRPKSPVYVGNGVHANLHVAFHRSSSEKIHSNEISSDSIGVLGYQKTVDHTKVNSKLSLFFEIKSKALEAQKQKSKDIIKLLNEQVNKEMNSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 149 - protein, 718 aa, Artificial Sequence
  Protein nanoparticle subunit carrier fusion
GADDVVDSSKSFVMENFSSYHGTKPGYVDSIQKGIQKPKSGTQGNYDDDWKEFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKTQPFLHDGYAVSWNTVEDSIIRTGFQGESGHDIKITAENTPLPIAGVLLPTIPGKLDVNKSKTHISVNGRKIRMRCRAIDGDVTFCRPKSPVYVGNGVHANLHVAFHRSSSEKIHSNEISSDSIGVLGYQKTVDHTKVNSKLSLFFEIKSKALEAQKQKKALEAQKQKSKDIIKLLNEQVNKEMNSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 150 - protein, 631 aa, Artificial Sequence; identical to SEQ ID NO: 109
  Protein nanoparticle subunit carrier fusion

SEQ ID NO: 151 - protein, 617 aa, Artificial Sequence
  Protein nanoparticle subunit carrier fusion
SATTTLKEQVLTTLKREQANAVVMYLNYKKYHWLTYGPLFRDLHLLFEEQGSEVFAMIDELAERSLMLDGQPVADPADYLKVATVTPSSGQLTVKQMIEEAIANHELIITEMHQDAEIATEAGDIGTADLYTRLVQTHQKHRWFLKEFLAKGDGLVSGGSGGGSGGKNLDCWVDNEEDIDVILKKSTILNLDINNDIISDISGFNSAVITYPDAQLVPGINGKAIHLVNNEASEVIVHKAMDIEYNDMFNQFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 152 - protein, 623 aa, Artificial Sequence
  Protein nanoparticle subunit carrier fusion
SATTTLKEQVLTTLKREQANAVVMYLNYKKYHWLTYGPLFRDLHLLFEEQGSEVFAMIDELAERSLMLDGQPVADPADYLKVATVTPSSGQLTVKQMIEEAIANHELIITEMHQDAEIATEAGDIGTADLYTRLVQTHQKHRWFLKEFLAKGDGLVSGGSGGGSGGGSGGSGKNLDCWVDNEEDIDVILKKSTILNLDINNDIISDISGFNSAVITYPDAQLVPGINGKAIHLVNNEASEVIVHKAMDIEYNDMFNQFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 153 - protein, 623 aa, Artificial Sequence
  Protein nanoparticle subunit carrier fusion
SATTTLKEQVLTTLKREQANAVVMYLNYKKYHWLTYGPLFRDLHLLFEEQGSEVFAMIDELAERSLMLDGQPVADPADYLKVATVTPSSGQLTVKQMIEEAIANHELIITEMHQDAEIATEAGDIGTADLYTRLVQTHQKHRWFLKEFLAKGDGLVSGGDSGGDGGGDGGDGKNLDCWVDNEEDIDVILKKSTILNLDINNDIISDISGFNSAVITYPDAQLVPGINGKAIHLVNNEASEVIVHKAMDIEYNDMFNQFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 154 - protein, 612 aa, Artificial Sequence
  Protein nanoparticle subunit carrier fusion
NLDCWVDNEEDIDVILKKSTILNLDINNDIISDISGFNSAVITYPDAQLVPGINGKAIHLVNNEASEVIVHKAMDIEYNDMFNQFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTNDGGSGGSATTTLKEQVLTTLKREQANAVVMYLNYKKYHWLTYGPLFRDLHLLFEEQGSEVFAMIDELAERSLMLDGQPVADPADYLKVATVTPSSGQLTVKQMIEEAIANHELIITEMHQDAEIATEAGDIGTADLYTRLVQTHQKHRWFLKEFLAKGDGLVS

SEQ ID NO: 155 - protein, 615 aa, Artificial Sequence
  Protein nanoparticle subunit carrier fusion
NLDCWVDNEEDIDVILKKSTILNLDINNDIISDISGFNSAVITYPDAQLVPGINGKAIHLVNNEASEVIVHKAMDIEYNDMFNQFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTNDGGSGGSGGSATTTLKEQVLTTLKREQANAVVMYLNYKKYHWLTYGPLFRDLHLLFEEQGSEVFAMIDELAERSLMLDGQPVADPADYLKVATVTPSSGQLTVKQMIEEAIANHELIITEMHQDAEIATEAGDIGTADLYTRLVQTHQKHRWFLKEFLAKGDGLVS

SEQ ID NO: 156 - protein, 615 aa, Artificial Sequence
  Protein nanoparticle subunit carrier fusion
NLDCWVDNEEDIDVILKKSTILNLDINNDIISDISGFNSAVITYPDAQLVPGINGKAIHLVNNEASEVIVHKAMDIEYNDMFNQFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTNDGGDGGDGGSATTTLKEQVLTTLKREQANAVVMYLNYKKYHWLTYGPLFRDLHLLFEEQGSEVFAMIDELAERSLMLDGQPVADPADYLKVATVTPSSGQLTVKQMIEEAIANHELIITEMHQDAEIATEAGDIGTADLYTRLVQTHQKHRWFLKEFLAKGDGLVS

SEQ ID NO: 157 - protein, 624 aa, Artificial Sequence
  Protein nanoparticle subunit carrier fusion
TTIHDVQTTGLTQDAVTGFDASSRLNAGLQEVLVDLTALHLQGKQAHWNIVGENWRDLHLQLDTLVEAARGFSDDVAERMRAVGGVPDARPQTVAASRIGDVGPDEIDTRACVEAIVALVRHTVDTIRRVHDPIDAEDPASADLLHAITLELEKQAWMIGSENRSPRRGGSGGKNLDCWVDNEEDIDVILKKSTILNLDINNDIISDISGFNSAVITYPDAQLVPGINGKAIHLVNNEASEVIVHKAMDIEYNDMFNQFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 158 - protein, 628 aa, Artificial Sequence
  Protein nanoparticle subunit carrier fusion
TTIHDVQTTGLTQDAVTGFDASSRLNAGLQEVLVDLTALHLQGKQAHWNIVGENWRDLHLQLDTLVEAARGFSDDVAERMRAVGGVPDARPQTVAASRIGDVGPDEIDTRACVEAIVALVRHTVDTIRRVHDPIDAEDPASADLLHAITLELEKQAWMIGSENRSPRRGGSGGGSGGKNLDCWVDNEEDIDVILKKSTILNLDINNDIISDISGFNSAVITYPDAQLVPGINGKAIHLVNNEASEVIVHKAMDIEYNDMFNQFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 159 - protein, 634 aa, Artificial Sequence
  Protein nanoparticle subunit carrier fusion
TTIHDVQTTGLTQDAVTGFDASSRLNAGLQEVLVDLTALHLQGKQAHWNIVGENWRDLHLQLDTLVEAARGFSDDVAERMRAVGGVPDARPQTVAASRIGDVGPDEIDTRACVEAIVALVRHTVDTIRRVHDPIDAEDPASADLLHAITLELEKQAWMIGSENRSPRRGGSGGGSGGGSGGSGKNLDCWVDNEEDIDVILKKSTILNLDINNDIISDISGFNSAVITYPDAQLVPGINGKAIHLVNNEASEVIVHKAMDIEYNDMFNQFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 160 - protein, 624 aa, Artificial Sequence
  Protein nanoparticle subunit carrier fusion
NLDCWVDNEEDIDVILKKSTILNLDINNDIISDISGFNSAVITYPDAQLVPGINGKAIHLVNNEASEVIVHKAMDIEYNDMFNQFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTNDGGSGGTTIHDVQTTGLTQDAVTGFDASSRLNAGLQEVLVDLTALHLQGKQAHWNIVGENWRDLHLQLDTLVEAARGFSDDVAERMRAVGGVPDARPQTVAASRIGDVGPDEIDTRACVEAIVALVRHTVDTIRRVHDPIDAEDPASADLLHAITLELEKQAWMIGSENRSPRRR

SEQ ID NO: 161 - protein, 628 aa, Artificial Sequence
  Protein nanoparticle subunit carrier fusion
NLDCWVDNEEDIDVILKKSTILNLDINNDIISDISGFNSAVITYPDAQLVPGINGKAIHLVNNEASEVIVHKAMDIEYNDMFNQFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTNDGGSGGGSGGTTIHDVQTTGLTQDAVTGFDASSRLNAGLQEVLVDLTALHLQGKQAHWNIVGENWRDLHLQLDTLVEAARGFSDDVAERMRAVGGVPDARPQTVAASRIGDVGPDEIDTRACVEAIVALVRHTVDTIRRVHDPIDAEDPASADLLHAITLELEKQAWMIGSENRSPRRR

SEQ ID NO: 162 - protein, 639 aa, Artificial Sequence
  Protein nanoparticle subunit carrier fusion
SETQTLLRNFGNVYDNPVLLDRSVTAPVTEGFNVVLASFQALYLQYQKHHFVVEGSEFYSLHEFFNEAYNQVQDHIHEIGERLDGLGGVPVATFSKLAELTCFEQESEGVYSSRQMVENDLAAEQAIIGVIRRQAAQAESLGDRGTRYLYEKILLKTEERAYHLSHFLAKDSLTLGFVQAAQSGGSGGKNLDCWVDNEEDIDVILKKSTILNLDINNDIISDISGFNSAVITYPDAQLVPGINGKAIHLVNNEASEVIVHKAMDIEYNDMFNQFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 163 - protein, 643 aa, Artificial Sequence
  Protein nanoparticle subunit carrier fusion
SETQTLLRNFGNVYDNPVLLDRSVTAPVTEGFNVVLASFQALYLQYQKHHFVVEGSEFYSLHEFFNEAYNQVQDHIHEIGERLDGLGGVPVATFSKLAELTCFEQESEGVYSSRQMVENDLAAEQAIIGVIRRQAAQAESLGDRGTRYLYEKILLKTEERAYHLSHFLAKDSLTLGFVQAAQSGGSGGGSGGKNLDCWVDNEEDIDVILKKSTILNLDINNDIISDISGFNSAVITYPDAQLVPGINGKAIHLVNNEASEVIVHKAMDIEYNDMFNQFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 164 - protein, 649 aa, Artificial Sequence
  Protein nanoparticle subunit carrier fusion
SETQTLLRNFGNVYDNPVLLDRSVTAPVTEGFNVVLASFQALYLQYQKHHFVVEGSEFYSLHEFFNEAYNQVQDHIHEIGERLDGLGGVPVATFSKLAELTCFEQESEGVYSSRQMVENDLAAEQAIIGVIRRQAAQAESLGDRGTRYLYEKILLKTEERAYHLSHFLAKDSLTLGFVQAAQSGGSGGGSGGGSGGSGKNLDCWVDNEEDIDVILKKSTILNLDINNDIISDISGFNSAVITYPDAQLVPGINGKAIHLVNNEASEVIVHKAMDIEYNDMFNQFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 165 - protein, 639 aa, Artificial Sequence
  Protein nanoparticle subunit carrier fusion
NLDCWVDNEEDIDVILKKSTILNLDINNDIISDISGFNSAVITYPDAQLVPGINGKAIHLVNNEASEVIVHKAMDIEYNDMFNQFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTNDGGSGGMSETQTLLRNFGNVYDNPVLLDRSVTAPVTEGFNVVLASFQALYLQYQKHHFVVEGSEFYSLHEFFNEAYNQVQDHIHEIGERLDGLGGVPVATFSKLAELTCFEQESEGVYSSRQMVENDLAAEQAIIGVIRRQAAQAESLGDRGTRYLYEKILLKTEERAYHLSHFLAKDSLTLGFVQAAQS

SEQ ID NO: 166 - protein, 643 aa, Artificial Sequence
  Protein nanoparticle subunit carrier fusion
NLDCWVDNEEDIDVILKKSTILNLDINNDIISDISGFNSAVITYPDAQLVPGINGKAIHLVNNEASEVIVHKAMDIEYNDMFNQFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTNDGGSGGGSGGMSETQTLLRNFGNVYDNPVLLDRSVTAPVTEGFNVVLASFQALYLQYQKHHFVVEGSEFYSLHEFFNEAYNQVQDHIHEIGERLDGLGGVPVATFSKLAELTCFEQESEGVYSSRQMVENDLAAEQAIIGVIRRQAAQAESLGDRGTRYLYEKILLKTEERAYHLSHFLAKDSLTLGFVQAAQS

SEQ ID NO: 167 - protein, 592 aa, Artificial Sequence
  Protein nanoparticle subunit carrier fusion
NLDCWVDNEEDIDVILKKSTILNLDINNDIISDISGFNSAVITYPDAQLVPGINGKAIHLVNNEASEVIVHKAMDIEYNDMFNQFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTNDGGSGGSGSGGAKLETVTLGNIGKDGKQTLVLNPRGVNPTNGVASLSQAGAVPALEKRVTVSVSQPSRNRKNYKVQVKIQNPTACTANGACDPSVTRQAYADVTFSFTQYSTDEERAFVRTELAALLASPLLIDAIDQLNPAY

SEQ ID NO: 168 - protein, 592 aa, Artificial Sequence
  Protein nanoparticle subunit carrier fusion
NLDCWVDNEEDIDVILKKSTILNLDINNDIISDISGFNSAVITYPDAQLVPGINGKAIHLVNNEASEVIVHKAMDIEYNDMFNQFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTNDGGDGSSGDGGAKLETVTLGNIGKDGKQTLVLNPRGVNPTNGVASLSQAGAVPALEKRVTVSVSQPSRNRKNYKVQVKIQNPTACTANGACDPSVTRQAYADVTFSFTQYSTDEERAFVRTELAALLASPLLIDAIDQLNPAY

SEQ ID NO: 169 - protein, 597 aa, Artificial Sequence
  Protein nanoparticle subunit carrier fusion
NLDCWVDNEEDIDVILKKSTILNLDINNDIISDISGFNSAVITYPDAQLVPGINGKAIHLVNNEASEVIVHKAMDIEYNDMFNQFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTNDGGSGGGSGGGSGGSGAKLETVTLGNIGKDGKQTLVLNPRGVNPTNGVASLSQAGAVPALEKRVTVSVSQPSRNRKNYKVQVKIQNPTACTANGACDPSVTRQAYADVTFSFTQYSTDEERAFVRTELAALLASPLLIDAIDQLNPAY

SEQ ID NO: 170 - protein, 597 aa, Artificial Sequence
  Protein nanoparticle subunit carrier fusion
NLDCWVDNEEDIDVILKKSTILNLDINNDIISDISGFNSAVITYPDAQLVPGINGKAIHLVNNEASEVIVHKAMDIEYNDMFNQFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTNDGGDSGGDGGGDGGDGAKLETVTLGNIGKDGKQTLVLNPRGVNPTNGVASLSQAGAVPALEKRVTVSVSQPSRNRKNYKVQVKIQNPTACTANGACDPSVTRQAYADVTFSFTQYSTDEERAFVRTELAALLASPLLIDAIDQLNPAY

SEQ ID NO: 171 - protein, 597 aa, Artificial Sequence
  Protein nanoparticle subunit carrier fusion
NLDCWVDNEEDIDVILKKSTILNLDINNDIISDISGFNSAVITYPDAQLVPGINGKAIHLVNNEASEVIVHKAMDIEYNDMFNQFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTNDGGSGGPPPPGSGGSGAKLETVTLGNIGKDGKQTLVLNPRGVNPTNGVASLSQAGAVPALEKRVTVSVSQPSRNRKNYKVQVKIQNPTACTANGACDPSVTRQAYADVTFSFTQYSTDEERAFVRTELAALLASPLLIDAIDQLNPAY

SEQ ID NO: 172 - protein, 693 aa, Artificial Sequence
  Protein nanoparticle subunit carrier fusion
GADDVVDSSKSFVMENFSSYHGTKPGYVDSIQKGIQKPKSGTQGNYDDDWKEFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKTQPFLHDGYAVSWNTVEDSIIRTGFQGESGHDIKITAENTPLPIAGVLLPTIPGKLDVNKSKTHISVNGRKIRMRCRAIDGDVTFCRPKSPVYVGNGVHANLHVAFHRSSSEKIHSNEISSDSIGVLGYQKTVDHTKVNSKLSLFFEIKSGGKSGGNKKSDGVKESSESTNTAIEDEDTKVRKQEIIKVTEQLIEAISNGDFESYTKMCDPGMTAFEPEALGNLVEGLDFHRFYFENLWSRNSKPVHTTILNPHIHLMGDESACIAYIRITQYLDAGGIPRTAQSEETRVWHRRDGKWQIVHFHRSGA

SEQ ID NO: 173 - protein, 682 aa, Artificial Sequence
  Protein nanoparticle subunit carrier fusion
GADDVVDSSKSFVMENFSSYHGTKPGYVDSIQKGIQKPKSGTQGNYDDDWKEFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKTQPFLHDGYAVSWNTVEDSIIRTGFQGESGHDIKITAENTPLPIAGVLLPTIPGKLDVNKSKTHISVNGRKIRMRCRAIDGDVTFCRPKSPVYVGNGVHANLHVAFHRSSSEKIHSNEISSDSIGVLGYQKTVDHTKVNSKLSLFFEIKSGVKESSESTNTAIEDEDTKVRKQEIIKVTEQLIEAISNGDFESYTKMCDPGMTAFEPEALGNLVEGLDFHRFYFENLWSRNSKPVHTTILNPHIHLMGDESACIAYIRITQYLDAGGIPRTAQSEETRVWHRRDGKWQIVHFHRSGA

SEQ ID NO: 174 - protein, 676 aa, Artificial Sequence
  Protein nanoparticle subunit carrier fusion
GADDVVDSSKSFVMENFSSYHGTKPGYVDSIQKGIQKPKSGTQGNYDDDWKEFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKTQPFLHDGYAVSWNTVEDSIIRTGFQGESGHDIKITAENTPLPIAGVLLPTIPGKLDVNKSKTHISVNGRKIRMRCRAIDGDVTFCRPKSPVYVGNGVHANLHVAFHRSSSEKIHSNEISSDSIGVLGYQKTVDHTKVNSKLSLFFEIKSGSTNTAIEDEDTKVRKQEIIKVTEQLIEAISNGDFESYTKMCDPGMTAFEPEALGNLVEGLDFHRFYFENLWSRNSKPVHTTILNPHIHLMGDESACIAYIRITQYLDAGGIPRTAQSEETRVWHRRDGKWQIVHFHRSGA

SEQ ID NO: 175 - protein, 499 aa, Artificial Sequence
  Protein nanoparticle subunit carrier fusion
SNMANTQMKSDKIIIAHRGASGYLPEHTLESKALAFAQQADYLEQDLAMTKDGRLVVIHDHFLDGLTDVAKKFPHRHRKDGRYYVIDFTLKEIQSLEMTENFETKDGKQAQVYPNRFPLWKSHFRIHTFEDEIEFIQGLEKSTGKKVGIYPEIKAPWFHHQNGKDIAAETLKVLKKYGYDKKTDMVYLQTFDFNELKRIKTELLPQMGMDLKLVQLIAYTDWKETQEKDPKGYWVNYNYDWMFKPGAMAEVVKYADGVGPGWYMLVNKEESKPDNIVYTPLVKELAQYNVEVHPYTVRKDALPEFFTDVNQMYDALLNKSGATGVFTDFPDTGVEFLKGIKGGKSGGNKKSDGVKESSESTNTAIEDEDTKVRKQEIIKVTEQLIEAISNGDFESYTKMCDPGMTAFEPEALGNLVEGLDFHRFYFENLWSRNSKPVHTTILNPHIHLMGDESACIAYIRITQYLDAGGIPRTAQSEETRVWHRRDGKWQIVHFHRSGA

SEQ ID NO: 176 - protein, 488 aa, Artificial Sequence
  Protein nanoparticle subunit carrier fusion
SNMANTQMKSDKIIIAHRGASGYLPEHTLESKALAFAQQADYLEQDLAMTKDGRLVVIHDHFLDGLTDVAKKFPHRHRKDGRYYVIDFTLKEIQSLEMTENFETKDGKQAQVYPNRFPLWKSHFRIHTFEDEIEFIQGLEKSTGKKVGIYPEIKAPWFHHQNGKDIAAETLKVLKKYGYDKKTDMVYLQTFDFNELKRIKTELLPQMGMDLKLVQLIAYTDWKETQEKDPKGYWVNYNYDWMFKPGAMAEVVKYADGVGPGWYMLVNKEESKPDNIVYTPLVKELAQYNVEVHPYTVRKDALPEFFTDVNQMYDALLNKSGATGVFTDFPDTGVEFLKGIKGVKESSESTNTAIEDEDTKVRKQEIIKVTEQLIEAISNGDFESYTKMCDPGMTAFEPEALGNLVEGLDFHRFYFENLWSRNSKPVHTTILNPHIHLMGDESACIAYIRITQYLDAGGIPRTAQSEETRVWHRRDGKWQIVHFHRSGA

SEQ ID NO: 177 - protein, 482 aa, Artificial Sequence
  Protein nanoparticle subunit carrier fusion
SNMANTQMKSDKIIIAHRGASGYLPEHTLESKALAFAQQADYLEQDLAMTKDGRLVVIHDHFLDGLTDVAKKFPHRHRKDGRYYVIDFTLKEIQSLEMTENFETKDGKQAQVYPNRFPLWKSHFRIHTFEDEIEFIQGLEKSTGKKVGIYPEIKAPWFHHQNGKDIAAETLKVLKKYGYDKKTDMVYLQTFDFNELKRIKTELLPQMGMDLKLVQLIAYTDWKETQEKDPKGYWVNYNYDWMFKPGAMAEVVKYADGVGPGWYMLVNKEESKPDNIVYTPLVKELAQYNVEVHPYTVRKDALPEFFTDVNQMYDALLNKSGATGVFTDFPDTGVEFLKGIKGSTNTAIEDEDTKVRKQEIIKVTEQLIEAISNGDFESYTKMCDPGMTAFEPEALGNLVEGLDFHRFYFENLWSRNSKPVHTTILNPHIHLMGDESACIAYIRITQYLDAGGIPRTAQSEETRVWHRRDGKWQIVHFHRSGA

SEQ ID NO: 178 - protein, 1168 aa, Artificial Sequence
  Protein nanoparticle subunit carrier fusion
GADDVVDSSKSFVMENFSSYHGTKPGYVDSIQKGIQKPKSGTQGNYDDDWKEFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKTQPFLHDGYAVSWNTVEDSIIRTGFQGESGHDIKITAENTPLPIAGVLLPTIPGKLDVNKSKTHISVNGRKIRMRCRAIDGDVTFCRPKSPVYVGNGVHANLHVAFHRSSSEKIHSNEISSDSIGVLGYQKTVDHTKVNSKLSLFFEIKSGGGGSGGGGSMQKRAIYPGTFDPITNGHIDIVTRATQMFDHVILAIAASPSKKPMFTLEERVALAQQATAHLGNVEVVGFSDLMANFARNQHATVLIRGLRAVADFEYEMQLAHMNRHLMPELESVFLMPSKEWSFISSSLVKEVARHQGDVTHFLPENVHQALMAKLAVDGGGGSGGGGSMKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 179 - protein, 974 aa, Artificial Sequence
  Protein nanoparticle subunit carrier fusion
SNMANTQMKSDKIIIAHRGASGYLPEHTLESKALAFAQQADYLEQDLAMTKDGRLVVIHDHFLDGLTDVAKKFPHRHRKDGRYYVIDFTLKEIQSLEMTENFETKDGKQAQVYPNRFPLWKSHFRIHTFEDEIEFIQGLEKSTGKKVGIYPEIKAPWFHHQNGKDIAAETLKVLKKYGYDKKTDMVYLQTFDFNELKRIKTELLPQMGMDLKLVQLIAYTDWKETQEKDPKGYWVNYNYDWMFKPGAMAEVVKYADGVGPGWYMLVNKEESKPDNIVYTPLVKELAQYNVEVHPYTVRKDALPEFFTDVNQMYDALLNKSGATGVFTDFPDTGVEFLKGIKGGGGSGGGGSMQKRAIYPGTFDPITNGHIDIVTRATQMFDHVILAIAASPSKKPMFTLEERVALAQQATAHLGNVEVVGFSDLMANFARNQHATVLIRGLRAVADFEYEMQLAHMNRHLMPELESVFLMPSKEWSFISSSLVKEVARHQGDVTHFLPENVHQALMAKLAVDGGGGSGGGGSMKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 180 - protein, 487 aa, Artificial Sequence
  Protein nanoparticle subunit carrier fusion
GYIPEAPRDGQAYVRKDGEWVLLSTFLGSGGGGGQMKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTND

SEQ ID NO: 181 - protein, 943 aa, Artificial Sequence
  Protein nanoparticle subunit carrier fusion
MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDGGGSGYIPEAPRDGQAYVRKDGEWVLLSTFLGSGGGGGQMKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTND

SEQ ID NO: 182 - protein, 487 aa, Artificial Sequence
  Protein nanoparticle subunit carrier fusion
GYIPEAPRDGQAYVRKDGEWVLLSTFLGSGGGGGQMKNLDCWVDKEEDIDVILKKSTILNLDINKDIISDISKFNSAVITYPDAQLVPGINGKAIHLVNNEKSEVIVHKAMKIEYNDMFNNFTVSFWLRVPKVSASHLEQYGTNEYSIISSMKKHKKSIGSGWSVSLKGNNLIWTLKDSKGEVRQITFRDLPKKFNAYLANKWVFITITNDRKSSANLYINGVLMGSAEITKLGAIREDNQITLKLDRCKNNNQYVSIDKFRIFCKALNPKEIEKLYTSYLSITFLRDFWGNPLRYDTEYYLIPVASSSKDVQLKQITDYMYLTKAPSYTNGKLNIYYRRLYNGLKFIIKRYKPNNKIDSFVKSGDFIKLYVSYKNNEHIVGYPKDGNAFNKLDRILRVGYKAPKIPLYKKMEAVKLRDLKTYSVQLKLYDDKQASLGLVGTHNGQIGKDPNRDILIASNWYFNHLKDKILGCDWYFVPTDEGWTND

SEQ ID NO: 183 - protein, 943 aa, Artificial Sequence
  Protein nanoparticle subunit carrier fusion
MKNLDCWVDKEEDIDVILKKSTILNLDINKDIISDISKFNSAVITYPDAQLVPGINGKAIHLVNNEKSEVIVHKAMKIEYNDMFNNFTVSFWLRVPKVSASHLEQYGTNEYSIISSMKKHKKSIGSGWSVSLKGNNLIWTLKDSKGEVRQITFRDLPKKFNAYLANKWVFITITNDRKSSANLYINGVLMGSAEITKLGAIREDNQITLKLDRCKNNNQYVSIDKFRIFCKALNPKEIEKLYTSYLSITFLRDFWGNPLRYDTEYYLIPVASSSKDVQLKQITDYMYLTKAPSYTNGKLNIYYRRLYNGLKFIIKRYKPNNKIDSFVKSGDFIKLYVSYKNNEHIVGYPKDGNAFNKLDRILRVGYKAPKIPLYKKMEAVKLRDLKTYSVQLKLYDDKQASLGLVGTHNGQIGKDPNRDILIASNWYFNHLKDKILGCDWYFVPTDEGWTNDGGGSGYIPEAPRDGQAYVRKDGEWVLLSTFLGSGGGGGQMKNLDCWVDKEEDIDVILKKSTILNLDINKDIISDISKFNSAVITYPDAQLVPGINGKAIHLVNNEKSEVIVHKAMKIEYNDMFNNFTVSFWLRVPKVSASHLEQYGTNEYSIISSMKKHKKSIGSGWSVSLKGNNLIWTLKDSKGEVRQITFRDLPKKFNAYLANKWVFITITNDRKSSANLYINGVLMGSAEITKLGAIREDNQITLKLDRCKNNNQYVSIDKFRIFCKALNPKEIEKLYTSYLSITFLRDFWGNPLRYDTEYYLIPVASSSKDVQLKQITDYMYLTKAPSYTNGKLNIYYRRLYNGLKFIIKRYKPNNKIDSFVKSGDFIKLYVSYKNNEHIVGYPKDGNAFNKLDRILRVGYKAPKIPLYKKMEAVKLRDLKTYSVQLKLYDDKQASLGLVGTHNGQIGKDPNRDILIASNWYFNHLKDKILGCDWYFVPTDEGWTND

SEQ ID NO: 184 - protein, 755 aa, Artificial Sequence
  Protein nanoparticle subunit carrier fusion
MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDGGAEAAAKEAAAKEAAAKEAAAKALEAEAAAKEAAAKEAAAKEAAAKAEPKSCDKTHTCPKCPAPELLGGPSVFLFPPKPKDTLMISRTPEVTCVVVDVSHEDPEVKFNWYVDGVEVHNAKTKPREEQYNSTYRVVSVLTVCLQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGSGGPTLYNVSLVMSDTAGTCY

SEQ ID NO: 185 - protein, 733 aa, Artificial Sequence
  Protein nanoparticle subunit carrier fusion
MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDGSPAPAPAPAPAPAPAPAPAPAPAPAEPKSCDKTHTCPKCPAPELLGGPSVFLFPPKPKDTLMISRTPEVTCVVVDVSHEDPEVKFNWYVDGVEVHNAKTKPREEQYNSTYRVVSVLTVCLQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGSGGPTLYNVSLVMSDTAGTCY

SEQ ID NO: 186 - protein, 726 aa, Artificial Sequence
  Protein nanoparticle subunit carrier fusion
MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDGGAEAAAKEAAAKEAAAKAEPKSCDKTHTCPKCPAPELLGGPSVFLFPPKPKDTLMISRTPEVTCVVVDVSHEDPEVKFNWYVDGVEVHNAKTKPREEQYNSTYRVVSVLTVCLQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGSGGPTLYNVSLVMSDTAGTCY

SEQ ID NO: 187 - protein, 723 aa, Artificial Sequence
  Protein nanoparticle subunit carrier fusion
MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDGSGSGSGSGSASGASGEPKSCDKTHTCPKCPAPELLGGPSVFLFPPKPKDTLMISRTPEVTCVVVDVSHEDPEVKFNWYVDGVEVHNAKTKPREEQYNSTYRVVSVLTVCLQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGSGGPTLYNVSLVMSDTAGTCY

SEQ ID NO: 188 - protein, 722 aa, Artificial Sequence
  Protein nanoparticle subunit carrier fusion
MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDGGGGSGGGGSGGGGSEPKSCDKTHTCPKCPAPELLGGPSVFLFPPKPKDTLMISRTPEVTCVVVDVSHEDPEVKFNWYVDGVEVHNAKTKPREEQYNSTYRVVSVLTVCLQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGSGGPTLYNVSLVMSDTAGTCY

SEQ ID NO: 189 - protein, 721 aa, Artificial Sequence
  Protein nanoparticle subunit carrier fusion
MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDGSAEAAAKEAAAKAEPKSCDKTHTCPKCPAPELLGGPSVFLFPPKPKDTLMISRTPEVTCVVVDVSHEDPEVKFNWYVDGVEVHNAKTKPREEQYNSTYRVVSVLTVCLQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGSGGPTLYNVSLVMSDTAGTCY

SEQ ID NO: 190 - protein, 715 aa, Artificial Sequence
  Protein nanoparticle subunit carrier fusion
MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDGGGGSASGEPKSCDKTHTCPKCPAPELLGGPSVFLFPPKPKDTLMISRTPEVTCVVVDVSHEDPEVKFNWYVDGVEVHNAKTKPREEQYNSTYRVVSVLTVCLQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGSGGPTLYNVSLVMSDTAGTCY

SEQ ID NO: 191 - protein, 715 aa, Artificial Sequence
  Protein nanoparticle subunit carrier fusion
MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDPAPAPASGEPKSCDKTHTCPKCPAPELLGGPSVFLFPPKPKDTLMISRTPEVTCVVVDVSHEDPEVKFNWYVDGVEVHNAKTKPREEQYNSTYRVVSVLTVCLQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGSGGPTLYNVSLVMSDTAGTCY

SEQ ID NO: 192 - protein, 787 aa, Artificial Sequence
  Protein nanoparticle subunit carrier fusion
GADDVVDSSKSFVMENFSSYHGTKPGYVDSIQKGIQKPKSGTQGNYDDDWKEFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKTQPFLHDGYAVSWNTVEDSIIRTGFQGESGHDIKITAENTPLPIAGVLLPTIPGKLDVNKSKTHISVNGRKIRMRCRAIDGDVTFCRPKSPVYVGNGVHANLHVAFHRSSSEKIHSNEISSDSIGVLGYQKTVDHTKVNSKLSLFFEIKGGGGSGGGGSGAAAKPATTEGEFPETREKMSGIRRAIAKAMVHSKHTAPHVTLMDEADVTKLVAHRKKFKAIAAEKGIKLTFLPYVVKALVSALREYPVLNTAIDDETEEIIQKHYYNIGIAADTDRGLLVPVIKHADRKPIFALAQEINELAEKARDGKLTPGEMKGASCTITNIGSAGGQWFTPVINHPEVAILGIGRIAEKPIVRDGEIVAAPMLALSLSFDHRMIDGATAQKALNHIKRLLSDPELLLM

SEQ ID NO: 193 - protein, 594 aa, Artificial Sequence
  Protein nanoparticle subunit carrier fusion
SNMANTQMKSDKIIIAHRGASGYLPEHTLESKALAFAQQADYLEQDLAMTKDGRLVVIHDHFLDGLTDVAKKFPHRHRKDGRYYVIDFTLKEIQSLEMTENFETKDGKQAQVYPNRFPLWKSHFRIHTFEDEIEFIQGLEKSTGKKVGIYPEIKAPWFHHQNGKDIAAETLKVLKKYGYDKKTDMVYLQTFDFNELKRIKTELLPQMGMDLKLVQLIAYTDWKETQEKDPKGYWVNYNYDWMFKPGAMAEVVKYADGVGPGWYMLVNKEESKPDNIVYTPLVKELAQYNVEVHPYTVRKDALPEFFTDVNQMYDALLNKSGATGVFTDFPDTGVEFLKGIKGGGGSGGGGSGAAAKPATTEGEFPETREKMSGIRRAIAKAMVHSKHTAPHVTLMDEADVTKLVAHRKKFKAIAAEKGIKLTFLPYVVKALVSALREYPVLNTAIDDETEEIIQKHYYNIGIAADTDRGLLVPVIKHADRKPIFALAQEINELAEKARDGKLTPGEMKGASCTITNIGSAGGQWFTPVINHPEVAILGIGRIAEKPIVRDGEIVAAPMLALSLSFDHRMIDGATAQKALNHIKRLLSDPELLLM

SEQ ID NO: 194 - protein, 788 aa, Artificial Sequence
  Protein nanoparticle subunit carrier fusion
GADDVVDSSKSFVMENFSSYHGTKPGYVDSIQKGIQKPKSGTQGNYDDDWKEFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKTQPFLHDGYAVSWNTVEDSIIRTGFQGESGHDIKITAENTPLPIAGVLLPTIPGKLDVNKSKTHISVNGRKIRMRCRAIDGDVTFCRPKSPVYVGNGVHANLHVAFHRSSSEKIHSNEISSDSIGVLGYQKTVDHTKVNSKLSLFFEIKSGGGGSGGGGSGAAAKPATTEGEFPETREKMSGIRRAIAKAMVHSKHTAPHVTLMDEADVTKLVAHRKKFKAIAAEKGIKLTFLPYVVKALVSALREYPVLNTAIDDETEEIIQKHYYNIGIAADTDRGLLVPVIKHADRKPIFALAQEINELAEKARDGKLTPGEMKGASCTITNIGSAGGQWFTPVINHPEVAILGIGRIAEKPIVRDGEIVAAPMLALSLSFDHRMIDGATAQKALNHIKRLLSDPELLLM

SEQ ID NO: 195 - protein, 746 aa, Artificial Sequence
  Protein nanoparticle subunit carrier fusion
MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDGGGGSGGGGSGGGGSGGGGSAEAAAKEAAAKAGGGGSGGGGSGGGGSGGGGSAAAKPATTEGEFPETREKMSGIRRAIAKAMVHSKHTAPHVTLMDEADVTKLVAHRKKFKAIAAEKGIKLTFLPYVVKALVSALREYPVLNTAIDDETEEIIQKHYYNIGIAADTDRGLLVPVIKHADRKPIFALAQEINELAEKARDGKLTPGEMKGASCTITNIGSAGGQWFTPVINHPEVAILGIGRIAEKPIVRDGEIVAAPMLALSLSFDHRMIDGATAQKALNHIKRLLSDPELLLM

SEQ ID NO: 196 - protein, 734 aa, Artificial Sequence
  Protein nanoparticle subunit carrier fusion
MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDGGGGSGGGGSGGGGSGGGGSGGGGSGGGGSGGGGSGGGGSAAAKPATTEGEFPETREKMSGIRRAIAKAMVHSKHTAPHVTLMDEADVTKLVAHRKKFKAIAAEKGIKLTFLPYVVKALVSALREYPVLNTAIDDETEEIIQKHYYNIGIAADTDRGLLVPVIKHADRKPIFALAQEINELAEKARDGKLTPGEMKGASCTITNIGSAGGQWFTPVINHPEVAILGIGRIAEKPIVRDGEIVAAPMLALSLSFDHRMIDGATAQKALNHIKRLLSDPELLLM

SEQ ID NO: 197 - protein, 714 aa, Artificial Sequence
  Protein nanoparticle subunit carrier fusion
MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDGGGGSGGGGSGGGGSGGGGSAAAKPATTEGEFPETREKMSGIRRAIAKAMVHSKHTAPHVTLMDEADVTKLVAHRKKFKAIAAEKGIKLTFLPYVVKALVSALREYPVLNTAIDDETEEIIQKHYYNIGIAADTDRGLLVPVIKHADRKPIFALAQEINELAEKARDGKLTPGEMKGASCTITNIGSAGGQWFTPVINHPEVAILGIGRIAEKPIVRDGEIVAAPMLALSLSFDHRMIDGATAQKALNHIKRLLSDPELLLM

SEQ ID NO: 198 - protein, 709 aa, Artificial Sequence
  Protein nanoparticle subunit carrier fusion
MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDGGGGSGGGGSGGGGSAAAKPATTEGEFPETREKMSGIRRAIAKAMVHSKHTAPHVTLMDEADVTKLVAHRKKFKAIAAEKGIKLTFLPYVVKALVSALREYPVLNTAIDDETEEIIQKHYYNIGIAADTDRGLLVPVIKHADRKPIFALAQEINELAEKARDGKLTPGEMKGASCTITNIGSAGGQWFTPVINHPEVAILGIGRIAEKPIVRDGEIVAAPMLALSLSFDHRMIDGATAQKALNHIKRLLSDPELLLM

SEQ ID NO: 199 - protein, 704 aa, Artificial Sequence
  Protein nanoparticle subunit carrier fusion
MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDGGGGSGGGGSAAAKPATTEGEFPETREKMSGIRRAIAKAMVHSKHTAPHVTLMDEADVTKLVAHRKKFKAIAAEKGIKLTFLPYVVKALVSALREYPVLNTAIDDETEEIIQKHYYNIGIAADTDRGLLVPVIKHADRKPIFALAQEINELAEKARDGKLTPGEMKGASCTITNIGSAGGQWFTPVINHPEVAILGIGRIAEKPIVRDGEIVAAPMLALSLSFDHRMIDGATAQKALNHIKRLLSDPELLLM

SEQ ID NO: 200 - protein, 702 aa, Artificial Sequence
  Protein nanoparticle subunit carrier fusion
MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDGGGGSASGAAAKPATTEGEFPETREKMSGIRRAIAKAMVHSKHTAPHVTLMDEADVTKLVAHRKKFKAIAAEKGIKLTFLPYVVKALVSALREYPVLNTAIDDETEEIIQKHYYNIGIAADTDRGLLVPVIKHADRKPIFALAQEINELAEKARDGKLTPGEMKGASCTITNIGSAGGQWFTPVINHPEVAILGIGRIAEKPIVRDGEIVAAPMLALSLSFDHRMIDGATAQKALNHIKRLLSDPELLLM

SEQ ID NO: 201 - protein, 744 aa, Artificial Sequence
  Protein nanoparticle subunit carrier fusion
MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDGGAEAAAKEAAAKEAAAKEAAAKALEAEAAAKEAAAKEAAAKEAAAKASGAAAKPATTEGEFPETREKMSGIRRAIAKAMVHSKHTAPHVTLMDEADVTKLVAHRKKFKAIAAEKGIKLTFLPYVVKALVSALREYPVLNTAIDDETEEIIQKHYYNIGIAADTDRGLLVPVIKHADRKPIFALAQEINELAEKARDGKLTPGEMKGASCTITNIGSAGGQWFTPVINHPEVAILGIGRIAEKPIVRDGEIVAAPMLALSLSFDHRMIDGATAQKALNHIKRLLSDPELLLM

SEQ ID NO: 202 - protein, 723 aa, Artificial Sequence
  Protein nanoparticle subunit carrier fusion
MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDGSAPAPAPAPAPAPAPAPAPAPAPAPASGAAAKPATTEGEFPETREKMSGIRRAIAKAMVHSKHTAPHVTLMDEADVTKLVAHRKKFKAIAAEKGIKLTFLPYVVKALVSALREYPVLNTAIDDETEEIIQKHYYNIGIAADTDRGLLVPVIKHADRKPIFALAQEINELAEKARDGKLTPGEMKGASCTITNIGSAGGQWFTPVINHPEVAILGIGRIAEKPIVRDGEIVAAPMLALSLSFDHRMIDGATAQKALNHIKRLLSDPELLLM

SEQ ID NO: 203 - protein, 714 aa, Artificial Sequence
  Protein nanoparticle subunit carrier fusion
MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDGAEAAAKEAAAKEAAAKASGAAAKPATTEGEFPETREKMSGIRRAIAKAMVHSKHTAPHVTLMDEADVTKLVAHRKKFKAIAAEKGIKLTFLPYVVKALVSALREYPVLNTAIDDETEEIIQKHYYNIGIAADTDRGLLVPVIKHADRKPIFALAQEINELAEKARDGKLTPGEMKGASCTITNIGSAGGQWFTPVINHPEVAILGIGRIAEKPIVRDGEIVAAPMLALSLSFDHRMIDGATAQKALNHIKRLLSDPELLLM

SEQ ID NO: 204 - protein, 710 aa, Artificial Sequence
  Protein nanoparticle subunit carrier fusion
MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDGSAEAAAKEAAAKASGAAAKPATTEGEFPETREKMSGIRRAIAKAMVHSKHTAPHVTLMDEADVTKLVAHRKKFKAIAAEKGIKLTFLPYVVKALVSALREYPVLNTAIDDETEEIIQKHYYNIGIAADTDRGLLVPVIKHADRKPIFALAQEINELAEKARDGKLTPGEMKGASCTITNIGSAGGQWFTPVINHPEVAILGIGRIAEKPIVRDGEIVAAPMLALSLSFDHRMIDGATAQKALNHIKRLLSDPELLLM

SEQ ID NO: 205 - protein, 809 aa, Artificial Sequence
  Protein nanoparticle subunit carrier fusion
SNMANTQMKSDKIIIAHRGASGYLPEHTLESKALAFAQQADYLEQDLAMTKDGRLVVIHDHFLDGLTDVAKKFPHRHRKDGRYYVIDFTLKEIQSLEMTENFETKDGKQAQVYPNRFPLWKSHFRIHTFEDEIEFIQGLEKSTGKKVGIYPEIKAPWFHHQNGKDIAAETLKVLKKYGYDKKTDMVYLQTFDFNELKRIKTELLPQMGMDLKLVQLIAYTDWKETQEKDPKGYWVNYNYDWMFKPGAMAEVVKYADGVGPGWYMLVNKEESKPDNIVYTPLVKELAQYNVEVHPYTVRKDALPEFFTDVNQMYDALLNKSGATGVFTDFPDTGVEFLKGIKSAEHVLTMLNEHEVKFVDLRFTDTKGKEQHVTIPAHQVNAEFFEEGKMFDGSSIGGWKGINESDMVLMPDASTAVIDPFFADSTLIIRCDILEPGTLQGYDRDPRSIAKRAEDYLRATGIADTVLFGPEPEFFLFDDIRFGASISGSHVAIDDIEGAWNSSTKYEGGNKGHRPGVKGGYFPVPPVDSAQDIRSEMCLVMEQMGLVVEAHHHEVATAGQNEVATRFNTMTKKADEIQIYKYVVHNVAHRFGKTATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEPMDKNLYDLPPEEAKEIPQVAGSLEEALNALDLDREFLKAGGVFTDEAIDAYIALRREEDDRVRMTPHPVEFELYYSV

SEQ ID NO: 206 - protein, 920 aa, Artificial Sequence
  Protein nanoparticle subunit carrier fusion
MKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTNDSAEHVLTMLNEHEVKFVDLRFTDTKGKEQHVTIPAHQVNAEFFEEGKMFDGSSIGGWKGINESDMVLMPDASTAVIDPFFADSTLIIRCDILEPGTLQGYDRDPRSIAKRAEDYLRATGIADTVLFGPEPEFFLFDDIRFGASISGSHVAIDDIEGAWNSSTKYEGGNKGHRPGVKGGYFPVPPVDSAQDIRSEMCLVMEQMGLVVEAHHHEVATAGQNEVATRFNTMTKKADEIQIYKYVVHNVAHRFGKTATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEPMDKNLYDLPPEEAKEIPQVAGSLEEALNALDLDREFLKAGGVFTDEAIDAYIALRREEDDRVRMTPHPVEFELYYSV

SEQ ID NO: 207 - protein, 924 aa, Artificial Sequence
  Protein nanoparticle subunit carrier fusion
MKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTNDGGGSSAEHVLTMLNEHEVKFVDLRFTDTKGKEQHVTIPAHQVNAEFFEEGKMFDGSSIGGWKGINESDMVLMPDASTAVIDPFFADSTLIIRCDILEPGTLQGYDRDPRSIAKRAEDYLRATGIADTVLFGPEPEFFLFDDIRFGASISGSHVAIDDIEGAWNSSTKYEGGNKGHRPGVKGGYFPVPPVDSAQDIRSEMCLVMEQMGLVVEAHHHEVATAGQNEVATRFNTMTKKADEIQIYKYVVHNVAHRFGKTATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEPMDKNLYDLPPEEAKEIPQVAGSLEEALNALDLDREFLKAGGVFTDEAIDAYIALRREEDDRVRMTPHPVEFELYYSV

SEQ ID NO: 208 - protein, 1003 aa, Artificial Sequence
  Protein nanoparticle subunit carrier fusion
GADDVVDSSKSFVMENFASYHGTKPGYVDSIQKGIQKPKSGTQGNYDDDWKEFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKAVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKTQPFLHDGYAVSWNTVEDSIIRTGFQGESGHDIKITAENTPLPIAGVLLPTIPGKLDVNKAKTHISVNGRKIRMRCRAIDGDVTFCRPKSPVYVGNGVHANLHVAFHRSSSEKIHSNEISSDSIGVLGYQKTVDHTKVNSKLSLFFEIKSSAEHVLTMLNEHEVKFVDLRFTDTKGKEQHVTIPAHQVNAEFFEEGKMFDGSSIGGWKGINESDMVLMPDASTAVIDPFFADSTLIIRCDILEPGTLQGYDRDPRSIAKRAEDYLRATGIADTVLFGPEPEFFLFDDIRFGASISGSHVAIDDIEGAWNSSTKYEGGNKGHRPGVKGGYFPVPPVDSAQDIRSEMCLVMEQMGLVVEAHHHEVATAGQNEVATRFNTMTKKADEIQIYKYVVHNVAHRFGKTATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEPMDKNLYDLPPEEAKEIPQVAGSLEEALNALDLDREFLKAGGVFTDEAIDAYIALRREEDDRVRMTPHPVEFELYYSV

SEQ ID NO: 209 - protein, 1007 aa, Artificial Sequence
  Protein nanoparticle subunit carrier fusion
GADDVVDSSKSFVMENFASYHGTKPGYVDSIQKGIQKPKSGTQGNYDDDWKEFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKAVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKTQPFLHDGYAVSWNTVEDSIIRTGFQGESGHDIKITAENTPLPIAGVLLPTIPGKLDVNKAKTHISVNGRKIRMRCRAIDGDVTFCRPKSPVYVGNGVHANLHVAFHRSSSEKIHSNEISSDSIGVLGYQKTVDHTKVNSKLSLFFEIKSGGGSSAEHVLTMLNEHEVKFVDLRFTDTKGKEQHVTIPAHQVNAEFFEEGKMFDGSSIGGWKGINESDMVLMPDASTAVIDPFFADSTLIIRCDILEPGTLQGYDRDPRSIAKRAEDYLRATGIADTVLFGPEPEFFLFDDIRFGASISGSHVAIDDIEGAWNSSTKYEGGNKGHRPGVKGGYFPVPPVDSAQDIRSEMCLVMEQMGLVVEAHHHEVATAGQNEVATRFNTMTKKADEIQIYKYVVHNVAHRFGKTATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEPMDKNLYDLPPEEAKEIPQVAGSLEEALNALDLDREFLKAGGVFTDEAIDAYIALRREEDDRVRMTPHPVEFELYYSV

SEQ ID NO: 210 - protein, 1011 aa, Artificial Sequence
  Protein nanoparticle subunit carrier fusion
GADDVVDSSKSFVMENFASYHGTKPGYVDSIQKGIQKPKSGTQGNYDDDWKEFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKAVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKTQPFLHDGYAVSWNTVEDSIIRTGFQGESGHDIKITAENTPLPIAGVLLPTIPGKLDVNKAKTHISVNGRKIRMRCRAIDGDVTFCRPKSPVYVGNGVHANLHVAFHRSSSEKIHSNEISSDSIGVLGYQKTVDHTKVNSKLSLFFEIKSGGGSGGGSSAEHVLTMLNEHEVKFVDLRFTDTKGKEQHVTIPAHQVNAEFFEEGKMFDGSSIGGWKGINESDMVLMPDASTAVIDPFFADSTLIIRCDILEPGTLQGYDRDPRSIAKRAEDYLRATGIADTVLFGPEPEFFLFDDIRFGASISGSHVAIDDIEGAWNSSTKYEGGNKGHRPGVKGGYFPVPPVDSAQDIRSEMCLVMEQMGLVVEAHHHEVATAGQNEVATRFNTMTKKADEIQIYKYVVHNVAHRFGKTATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEPMDKNLYDLPPEEAKEIPQVAGSLEEALNALDLDREFLKAGGVFTDEAIDAYIALRREEDDRVRMTPHPVEFELYYSV

SEQ ID NO: 211 - protein, 681 aa, Artificial Sequence
  Protein nanoparticle subunit carrier fusion
PIVQNLQGQMVHQAISCLCLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTHNPPIPVGEIYKRWIILGLNKIVRMYSPTSILDIRQGPKEPFRDYVDRFYKTLRAEQASQEVKNAATETLLVQNANPDCKTILKALGPGATLEEMMTACQGVGGPGHKARVKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 212 - protein, 688 aa, Artificial Sequence
  Protein nanoparticle subunit carrier fusion
PIVQNLQGQMVHQAISCLCLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTHNPPIPVGEIYKRWIILGLNKIVRMYSPTSILDIRQGPKEPFRDYVDRFYKTLRAEQASQEVKNAATETLLVQNANPDCKTILKALGPGATLEEMMTACQGVGGPGHKARVPIPFSYSKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 213 - protein, 710 aa, Artificial Sequence
  Protein nanoparticle subunit carrier fusion
PIVQNLQGQMVHQAISCLCLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTHNPPIPVGEIYKRWIILGLNKIVRMYSPTSILDIRQGPKEPFRDYVDRFYKTLRAEQASQEVKNAATETLLVQNANPDCKTILKALGPGATLEEMMTACQGVGGPGHKARVSKFIGITELKKLESKINKVFSTPIPFSYSKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 214 - protein, 694 aa, Artificial Sequence
  Protein nanoparticle subunit carrier fusion
PIVQNLQGQMVHQAISCLCLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTHNPPIPVGEIYKRWIILGLNKIVRMYSPTSILDIRQGPKEPFRDYVDRFYKTLRAEQASQEVKNAATETLLVQNANPDCKTILKALGPGATLEEMMTAIGITELKKLESKINKVFSTPIPFSYSKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 215 - protein, 693 aa, Artificial Sequence
  Protein nanoparticle subunit carrier fusion
PIVQNLQGQMVHQAISCLCLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTHNPPIPVGEIYKRWIILGLNKIVRMYSPTSILDIRQGPKEPFRDYVDRFYKTLRAEQASQEVKNAATETLLVQNANPDCKTILKALGPGATLEEMMTAGITELKKLESKINKVFSTPIPFSYSKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 216 - protein, 692 aa, Artificial Sequence
  Protein nanoparticle subunit carrier fusion
PIVQNLQGQMVHQAISCLCLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTHNPPIPVGEIYKRWIILGLNKIVRMYSPTSILDIRQGPKEPFRDYVDRFYKTLRAEQASQEVKNAATETLLVQNANPDCKTILKALGPGATLEEMMTAITELKKLESKINKVFSTPIPFSYSKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 217 - protein, 691 aa, Artificial Sequence
  Protein nanoparticle subunit carrier fusion
PIVQNLQGQMVHQAISCLCLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTHNPPIPVGEIYKRWIILGLNKIVRMYSPTSILDIRQGPKEPFRDYVDRFYKTLRAEQASQEVKNAATETLLVQNANPDCKTILKALGPGATLEEMMTATELKKLESKINKVFSTPIPFSYSKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 218 - protein, 691 aa, Artificial Sequence; identical to SEQ ID NO: 217
  Protein nanoparticle subunit carrier fusion

SEQ ID NO: 219 - protein, 682 aa, Artificial Sequence
  Protein nanoparticle subunit carrier fusion
PIVQNLQGQMVHQCISPRTLNAWVKVVEEKAFSPEVIPMFSALSCGATPQDLNTMLNTVGGHQAAMQMLKETINEEAAEWDRLHPVHAGPIAPGQMREPRGSDIAGTTSTLQEQIGWMTHNPPIPVGEIYKRWIILGLNKIVRMYSPTSILDIRQGPKEPFRDYVDRFYKTLRAEQASQEVKNAATETLLVQNANPDCKTILKALGPGATLEEMMTACQGVGGPGHKARVLKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 220 - protein, 30 aa, Artificial Sequence
  Protein nanoparticle subunit carrier fusion
MDSKGSSQKGSRLLLLLVVSNLLLPQGVVA

SEQ ID NO: 221 - protein, 13 aa, Artificial Sequence
  T-cell helper epitope
AKFVAAWTLKAAA

SEQ ID NO: 222 - protein, 776 aa, Artificial Sequence
  Recombinant Meningococcal outer membrane protein
DFTIQDIRVEGLQRTEPSTVFNYLPVKVGDTYNDTHGSAIIKSLYATGFFDDVRVETADGQLLLTVIERPTIGSLNITGAKMLQNDAIKKNLESFGLAQSQYFNQATLNQAVAGLKEEYLGRGKLNIQITPKVTKLARNRVDIDITIDEGKSAKITDIEFEGNQVYSDRKLMRQMSLTEGGIWTWLTRSNQFNEQKFAQDMEKVTDFYQNNGYFDFRILDTDIQTNEDKTKQTIKITVHEGERFRWGKVSIEGDTNEVPKAELEKLLTMKPGKWYERQQMTAVLGEIQNRMGSAGYAYSEISVQPLPNAETKTVDFVLHIEPGRKIYVNEIHITGNNKTRDEVVRRELRQMESAPYDTSKLQRSKERVELLGYFDNVQFDAVPLAGTPDKVDLNMSLTERSTGSLDLSAGWVQDTGLVMSAGVSQDNLFGTGKSAALRASRSKTTLNGSLSFTDPYFTADGVSLGYDVYGKAFDPRKASTSIKQYKTTTAGAGIRMSVPVTEYDRVNFGLVAEHLTVNTYNKAPKHYADFIKKYGKTDGTDGSFKGWLYKGTVGWGRNKTDSALWPTRGYLTGVNAEIALPGSKLQYYSATHNQTWFFPLSKTFTLMFGGEVGIAGGYGKTKEIPFFENFYGGGLGSVRGYESGTLGPKVYDEYGEKISYGGNKKANVSAELLFPMPGAKDARTVRLSLFADAGSVWDGKTYDDNSSSATGGRVQNIYGAGNTHKSTFTNELRYSAGGAVTWLSPLGPMKFSYAYPLKKKPEDEIQRFQFQLGTTF

SEQ ID NO: 223 - protein, 184 aa, Artificial Sequence
  Recombinant Outer-membrane lipoprotein carrier
QAGAVDALKQFNNDADGISGSFTQTVQSKKKTQTAHGTFKILRPGLFKWEYTSPYKQTIVGDGQTVWLYDVDLAQVTKSSQDQAIGGSPAAILSNKTALESSYTLKEDGSSNGIDYVLATPKRNNAGYQYIRIGFKGGNLAAMQLKDSFGNQTSISFGGLNTNPQLSRGAFKFTPPKGVDVLSN

SEQ ID NO: 224 - protein, 105 aa, Artificial Sequence
  Recombinant Cholera Toxin B Subunit
NGTPQNITDLCAEYHNTQIHTLNDKIFSYTESLAGKREMAIITFKNGATFQVEVPGSQHIDSQKKAIERMKDTLRIAYLTEAKVEKLCVWNNKTPHAIAAISMAN

SEQ ID NO: 225 - protein, 17 aa, Artificial Sequence
  T-cell helper epitope
NEDQKIGIEIIKRALKI

SEQ ID NO: 226 - protein, 21 aa, Artificial Sequence
  T-cell helper epitope
FNNFTVSFWLRVPKVSASHLE

SEQ ID NO: 227 - protein, 19 aa, Artificial Sequence
  T-cell helper epitope
PVFAGANYAAWAVNVAQVI

SEQ ID NO: 228 - protein, 19 aa, Artificial Sequence
  T-cell helper epitope
HHNTEEIVAQSIALSSLMV

SEQ ID NO: 229 - protein, 20 aa, Artificial Sequence
  T-cell helper epitope
QSIALSSLMVAQAIPLVGEL

SEQ ID NO: 230 - protein, 20 aa, Artificial Sequence
  T-cell helper epitope
VDIGFAAYNFVESIINLFQV

SEQ ID NO: 231 - protein, 20 aa, Artificial Sequence
  T-cell helper epitope
QGESGHDIKITAENTPLPIA

SEQ ID NO: 232 - protein, 20 aa, Artificial Sequence
  T-cell helper epitope
GVLLPTIPGKLDVNKSKTHI

SEQ ID NO: 233 - protein, 20 aa, Artificial Sequence
  T-cell helper epitope
NSVDDALINSTKIYSYFPSV

SEQ ID NO: 234 - protein, 15 aa, Artificial Sequence
  T-cell helper epitope
QYIKANSKFIGITEL

SEQ ID NO: 235 - protein, 17 aa, Artificial Sequence
  T-cell helper epitope
PGINGKAIHLVNNESSE

SEQ ID NO: 236 - protein, 21 aa, Artificial Sequence
  T-cell helper epitope
FNNFTVSFWLRVPKVSASHLE

SEQ ID NO: 237 - protein, 15 aa, Artificial Sequence
  T-cell helper epitope
TQLFNSTWFNSTWST

SEQ ID NO: 238 - protein, 15 aa, Artificial Sequence
  T-cell helper epitope
EQIWNHTTWMEWDRE

SEQ ID NO: 239 - protein, 26 aa, Artificial Sequence
  T-cell helper epitope
IRGQIRCSSNITGLLLTRDGGNNAAA

SEQ ID NO: 240 - protein, 23 aa, Artificial Sequence
  T-cell helper epitope
QCTHGIRPVVSTQLLLNGSLAEE

SEQ ID NO: 241 - protein, 23 aa, Artificial Sequence
  T-cell helper epitope
NDNTSYRLISCNTSVITQACPKV

SEQ ID NO: 242 - protein, 23 aa, Artificial Sequence
  T-cell helper epitope
SENFTNNAKIIIVQLNESVVINC

SEQ ID NO: 243 - protein, 23 aa, Artificial Sequence
  T-cell helper epitope
EVVIRSENFTNNAKTIIVQLNES

SEQ ID NO: 244 - protein, 23 aa, Artificial Sequence
  T-cell helper epitope
TVQCTHGIRPVVSTQLLLNGSLA

SEQ ID NO: 245 - protein, 23 aa, Artificial Sequence
  T-cell helper epitope
ESVVINCTRPNNNTRRSIHIGPG

SEQ ID NO: 246 - protein, 612 aa, Artificial Sequence
  Protein nanoparticle subunit carrier fusion
MQIYEGKLTAEGLRFGIVASRFNHALVDRLVEGCIDCIVRHGGREEDITLVRVPGSWEIPVAAGELARKEDIDAVIAIGVLIRGATPHFDYIASEVSKGLANLSLELRKPITFGVITADTLEQAIERAGTKHGNKCWEAALSAIEMANLFKSLRGSGSGSMKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTND

SEQ ID NO: 247 - protein, 706 aa, Artificial Sequence
  Protein nanoparticle subunit carrier fusion
MQIYEGKLTAEGLRFGIVASRFNHALVDRLVEGCIDCIVRHGGREEDITLVRVPGSWEIPVAAGELARKEDIDAVIAIGVLIRGATPHFDYIASEVSKGLANLSLELRKPITFGVITADTLEQAIERAGTKHGNKCWEAALSAIEMANLFKSLRGSGSGSDYKDDDDKGSGGADDVVDSSKSFVMENFASYHGTKPGYVDSIQKGIQKPKSGTQGNYDDDWKEFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKAVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKTQPFLHDGYAVSWNTVEDSIIRTGFQGESGHDIKITAENTPLPIAGVLLPTIPGKLDVNKAKTHISVNGRKIRMRCRAIDGDVTFCRPKSPVYVGNGVHANLHVAFHRSSSEKIHSNEISSDSIGVLGYQKTVDHTKVNSKLSLFFEIKS

SEQ ID NO: 248 - protein, 1246 aa, Artificial Sequence
  Protein nanoparticle subunit carrier fusion
MQIYEGKLTAEGLRFGIVASRFNHALVDRLVEGCIDCIVRHGGREEDITLVRVPGSWEIPVAAGELARKEDIDAVIAIGVLIRGATPHFDYIASEVSKGLANLSLELRKPITFGVITADTLEQAIERAGTKHGNKCWEAALSAIEMANLFKSLRGSGDYKDDDDKGSGGADDVVDSSKSFVMENFASYHGTKPGYVDSIQKGIQKPKSGTQGNYDDDWKEFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKAVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKTQPFLHDGYAVSWNTVEDSIIRTGFQGESGHDIKITAENTPLPIAGVLLPTIPGKLDVNKAKTHISVNGRKIRMRCRAIDGDVTFCRPKSPVYVGNGVHANLHVAFHRSSSEKIHSNEISSDSIGVLGYQKTVDHTKVNSKLSLFFEIKSGGGSGGGSGADDVVDSSKSFVMENFASYHGTKPGYVDSIQKGIQKPKSGTQGNYDDDWKEFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKAVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKTQPFLHDGYAVSWNTVEDSIIRTGFQGESGHDIKITAENTPLPIAGVLLPTIPGKLDVNKAKTHISVNGRKIRMRCRAIDGDVTFCRPKSPVYVGNGVHANLHVAFHRSSSEKIHSNEISSDSIGVLGYQKTVDHTKVNSKLSLFFEIKS

SEQ ID NO: 249 - protein, 509 aa, Artificial Sequence
  Protein nanoparticle subunit carrier fusion
MQIYEGKLTAEGLRFGIVASRFNHALVDRLVEGCIDCIVRHGGREEDITLVRVPGSWEIPVAAGELARKEDIDAVIAIGVLIRGATPHFDYIASEVSKGLANLSLELRKPITFGVITADTLEQAIERAGTKHGNKCWEAALSAIEMANLFKSLRGSGDYKDDDDKGSGSNMANTQMKSDKIIIAHRGASGYLPEHTLESKALAFAQQADYLEQDLAMTKDGRLVVIHDHFLDGLTDVAKKFPHRHRKDGRYYVIDFTLKEIQSLEMTENFETKDGKQAQVYPNRFPLWKSHFRIHTFEDEIEFIQGLEKSTGKKVGIYPEIKAPWFHHQNGKDIAAETLKVLKKYGYDKKTDMVYLQTFDFNELKRIKTELLPQMGMDLKLVQLIAYTDWKETQEKDPKGYWVNYNYDWMFKPGAMAEVVKYADGVGPGWYMLVNKEESKPDNIVYTPLVKELAQYNVEVHPYTVRKDALPEFFTDVNQMYDALLNKSGATGVFTDFPDTGVEFLKGIK

SEQ ID NO: 250 - protein, 634 aa, Artificial Sequence
  Protein nanoparticle subunit carrier fusion
MKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTNDGSGDYKDDDDKGSGMQIYEGKLTAEGLRFGIVASRFNHALVDRLVEGCIDCIVRHGGREEDITLVRVPGSWEIPVAAGELARKEDIDAVIAIGVLIRGATPHFDYIASEVSKGLANLSLELRKPITFGVITADTLEQAIERAGTKHGNKCWEAALSAIEMANLFKSLRGSGDYKDDDDKGSG

SEQ ID NO: 251 - protein, 509 aa, Artificial Sequence
  Protein nanoparticle subunit carrier fusion
SNMANTQMKSDKIIIAHRGASGYLPEHTLESKALAFAQQADYLEQDLAMTKDGRLVVIHDHFLDGLTDVAKKFPHRHRKDGRYYVIDFTLKEIQSLEMTENFETKDGKQAQVYPNRFPLWKSHFRIHTFEDEIEFIQGLEKSTGKKVGIYPEIKAPWFHHQNGKDIAAETLKVLKKYGYDKKTDMVYLQTFDFNELKRIKTELLPQMGMDLKLVQLIAYTDWKETQEKDPKGYWVNYNYDWMFKPGAMAEVVKYADGVGPGWYMLVNKEESKPDNIVYTPLVKELAQYNVEVHPYTVRKDALPEFFTDVNQMYDALLNKSGATGVFTDFPDTGVEFLKGIKGSGDYKDDDDKGSGMQIYEGKLTAEGLRFGIVASRFNHALVDRLVEGCIDCIVRHGGREEDITLVRVPGSWEIPVAAGELARKEDIDAVIAIGVLIRGATPHFDYIASEVSKGLANLSLELRKPITFGVITADTLEQAIERAGTKHGNKCWEAALSAIEMANLFKSLR

SEQ ID NO: 252 - protein, 703 aa, Artificial Sequence
  Protein nanoparticle subunit carrier fusion
GADDVVDSSKSFVMENFASYHGTKPGYVDSIQKGIQKPKSGTQGNYDDDWKEFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKAVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKTQPFLHDGYAVSWNTVEDSIIRTGFQGESGHDIKITAENTPLPIAGVLLPTIPGKLDVNKAKTHISVNGRKIRMRCRAIDGDVTFCRPKSPVYVGNGVHANLHVAFHRSSSEKIHSNEISSDSIGVLGYQKTVDHTKVNSKLSLFFEIKSGSGDYKDDDDKGSGMQIYEGKLTAEGLRFGIVASRFNHALVDRLVEGCIDCIVRHGGREEDITLVRVPGSWEIPVAAGELARKEDIDAVIAIGVLIRGATPHFDYIASEVSKGLANLSLELRKPITFGVITADTLEQAIERAGTKHGNKCWEAALSAIEMANLFKSLR

SEQ ID NO: 253 - protein, 1246 aa, Artificial Sequence
  Protein nanoparticle subunit carrier fusion
GADDVVDSSKSFVMENFASYHGTKPGYVDSIQKGIQKPKSGTQGNYDDDWKEFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKAVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKTQPFLHDGYAVSWNTVEDSIIRTGFQGESGHDIKITAENTPLPIAGVLLPTIPGKLDVNKAKTHISVNGRKIRMRCRAIDGDVTFCRPKSPVYVGNGVHANLHVAFHRSSSEKIHSNEISSDSIGVLGYQKTVDHTKVNSKLSLFFEIKSGGGSGGGSGADDVVDSSKSFVMENFASYHGTKPGYVDSIQKGIQKPKSGTQGNYDDDWKEFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKAVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKTQPFLHDGYAVSWNTVEDSIIRTGFQGESGHDIKITAENTPLPIAGVLLPTIPGKLDVNKAKTHISVNGRKIRMRCRAIDGDVTFCRPKSPVYVGNGVHANLHVAFHRSSSEKIHSNEISSDSIGVLGYQKTVDHTKVNSKLSLFFEIKSGSGDYKDDDDKGSGMQIYEGKLTAEGLRFGIVASRFNHALVDRLVEGCIDCIVRHGGREEDITLVRVPGSWEIPVAAGELARKEDIDAVIAIGVLIRGATPHFDYIASEVSKGLANLSLELRKPITFGVITADTLEQAIERAGTKHGNKCWEAALSAIEMANLFKSLR

SEQ ID NO: 254 - protein, 723 aa, Artificial Sequence
  Protein nanoparticle subunit carrier fusion
MEFLKRSFAPLTEKQWQEIDNRAREIFKTQLYGRKFVDVEGPYGWEYAAHPLCEVEVLSDENEVVKWGLRKSLPLIELRATFTLDLWELDNLECGKPNVDLSSLEETVRKVAEFEDEVIFRGCEKSGVKGLLSFEERKIECGSTPKDLLEAIVRALSIFSKDGIEGPYTLVINTDRWINFLKEEAGHYPLEKRVEECLRGGKIITTPRIEDALVVSERGGDFKLILGQDLSIGYEDREKDAVRLFITETFTFQVVNPEALILLKFGSGSGSMKNLDCWVDNEEDIDVILKKSTILNLDINNDIISDISGFNSAVITYPDAQLVPGINGKAIHLVNNEASEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNQITLKLDRCNNNNQYVSIDKFRIFCKALNPKEIEKLYTSYLSITFLRDFWGNPLRYDTEYYLIPVASSSKDVQLKQITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKQASLGLVGTHNGQIGNDPNRDILIASNWYFNHLKDKILGCDWYFVPTDEGWTND

SEQ ID NO: 255 - protein, 806 aa, Artificial Sequence
  Protein nanoparticle subunit carrier fusion
MEFLKRSFAPLTEKQWQEIDNRAREIFKTQLYGRKFVDVEGPYGWEYAAHPLCEVEVLSDENEVVKWGLRKSLPLIELRATFTLDLWELDNLECGKPNVDLSSLEETVRKVAEFEDEVIFRGCEKSGVKGLLSFEERKIECGSTPKDLLEAIVRALSIFSKDGIEGPYTLVINTDRWINFLKEEAGHYPLEKRVEECLRGGKIITTPRIEDALVVSERGGDFKLILGQDLSIGYEDREKDAVRLFITETFTFQVVNPEALILLKFGSGSGSGADDVVDSSKSFVMENFASYHGTKPGYVDSIQKGIQKPKSGTQGNYDDDWKEFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKAVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKTQPFLHDGYAVSWNTVEDSIIRTGFQGESGHDIKITAENTPLPIAGVLLPTIPGKLDVNKAKTHISVNGRKIRMRCRAIDGDVTFCRPKSPVYVGNGVHANLHVAFHRSSSEKIHSNEISSDSIGVLGYQKTVDHTKVNSKLSLFFEIKS

SEQ ID NO: 256 - protein, 1357 aa, Artificial Sequence
  Protein nanoparticle subunit carrier fusion
MEFLKRSFAPLTEKQWQEIDNRAREIFKTQLYGRKFVDVEGPYGWEYAAHPLCEVEVLSDENEVVKWGLRKSLPLIELRATFTLDLWELDNLECGKPNVDLSSLEETVRKVAEFEDEVIFRGCEKSGVKGLLSFEERKIECGSTPKDLLEAIVRALSIFSKDGIEGPYTLVINTDRWINFLKEEAGHYPLEKRVEECLRGGKIITTPRIEDALVVSERGGDFKLILGQDLSIGYEDREKDAVRLFITETFTFQVVNPEALILLKFGSGDYKDDDDKGSGGADDVVDSSKSFVMENFASYHGTKPGYVDSIQKGIQKPKSGTQGNYDDDWKEFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKAVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKTQPFLHDGYAVSWNTVEDSIIRTGFQGESGHDIKITAENTPLPIAGVLLPTIPGKLDVNKAKTHISVNGRKIRMRCRAIDGDVTFCRPKSPVYVGNGVHANLHVAFHRSSSEKIHSNEISSDSIGVLGYQKTVDHTKVNSKLSLFFEIKSGGGSGGGSGADDVVDSSKSFVMENFASYHGTKPGYVDSIQKGIQKPKSGTQGNYDDDWKEFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKALSVELEINFETRGKRGQDAMYEYMAQACAGNRVRRSVGSSLSCINLDWDVIRDKTKTKIESLKEHGPIKNKMSESPNKAVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKTQPFLHDGYAVSWNTVEDSIIRTGFQGESGHDIKITAENTPLPIAGVLLPTIPGKLDVNKAKTHISVNGRKIRMRCRAIDGDVTFCRPKSPVYVGNGVHANLHVAFHRSSSEKIHSNEISSDSIGVLGYQKTVDHTKVNSKLSLFFEIKS

SEQ ID NO: 257 - protein, 620 aa, Artificial Sequence
  Protein nanoparticle subunit carrier fusion
MEFLKRSFAPLTEKQWQEIDNRAREIFKTQLYGRKFVDVEGPYGWEYAAHPLCEVEVLSDENEVVKWGLRKSLPLIELRATFTLDLWELDNLECGKPNVDLSSLEETVRKVAEFEDEVIFRGCEKSGVKGLLSFEERKIECGSTPKDLLEAIVRALSIFSKDGIEGPYTLVINTDRWINFLKEEAGHYPLEKRVEECLRGGKIITTPRIEDALVVSERGGDFKLILGQDLSIGYEDREKDAVRLFITETFTFQVVNPEALILLKFGSGDYKDDDDKGSGSNMANTQMKSDKIIIAHRGASGYLPEHTLESKALAFAQQADYLEQDLAMTKDGRLVVIHDHFLDGLTDVAKKFPHRHRKDGRYYVIDFTLKEIQSLEMTENFETKDGKQAQVYPNRFPLWKSHFRIHTFEDEIEFIQGLEKSTGKKVGIYPEIKAPWFHHQNGKDIAAETLKVLKKYGYDKKTDMVYLQTFDFNELKRIKTELLPQMGMDLKLVQLIAYTDWKETQEKDPKGYWVNYNYDWMFKPGAMAEVVKYADGVGPGWYMLVNKEESKPDNIVYTPLVKELAQYNVEVHPYTVRKDALPEFFTDVNQMYDALLNKSGATGVFTDFPDTGVEFLKGIK

SEQ ID NO: 258 - protein, 167 aa, Artificial Sequence
  recombinant ferritin subunit
MLSKDIIKLLNEQVNKEMQSSNLYMSMSCWCYTHSLDGAGLFLFDHAAEEYEHAKKLIIFLNENNVPCQLTSISAPEHKFEGLTQIFQKAYEHEQHISESINNIVDHAIKSKDHCTFNFLQWYVAEQCEEEVLFKDILDKIELIGNENHGLYLADQYVKGIAKSRKS

SEQ ID NO: 259 - protein, 168 aa, Artificial Sequence
  recombinant ferritin subunit
MLSKDIIKLLNEQVNKEMQSSNLYMSMSSWCYTHSLDGAGLFLFDHAAEEYEHAKKLIIFLNENNVPVQLTGCISAPEHKFEGLTQIFQKAYEHEQHISESINNIVDHAIKSKDHCTFNFLQWYVAEQCEEEVLFKDILDKIELIGNENHGLYLADQYVKGIAKSRKS

SEQ ID NO: 260 - protein, 167 aa, Artificial Sequence
  recombinant ferritin subunit
MLSKDIIKLLNEQVNKEMQSSNLYMSMSSWCYTHSLDGAGLFLFDHAAEEYEHAKKLIIFLNENNVPVQLTCISCPEHKFEGLTQIFQKAYEHEQHISESINNIVDHAIKSKDHCTFNFLQWYVAEQCEEEVLFKDILDKIELIGNENHGLYLADQYVKGIAKSRKS

SEQ ID NO: 261 - protein, 167 aa, Artificial Sequence
  recombinant ferritin subunit
MLSKDIIKLLNEQVNKEMQSSNLYMSMSSWCYTHSLDGAGLFLFDHAAEEYEHAKKLIIFLNENNVPVQLTSCSAPEHKFEGLTQIFQKAYEHEQHISESINNIVDHAIKSKDHCTFNFLQWYVAEQCEEEVLFKDILDKIELIGNENHGLYLADQYVKGIAKSRKS

SEQ ID NO: 262 - protein, 167 aa, Artificial Sequence
  recombinant ferritin subunit
MLSKDIIKLLNEQVNKEMQSSNLYMSMSCWCYTHSLDGAGLFLFDHAAEEYEHAKKLIIFLNCNNVPCQLTSISAPEHKFEGLTQIFQKAYEHEQHISESINNIVDHAIKSKDHATFNFLQWYVAEQHEEECLFKDILDKIELIGNENHGLYLADQYVKGIAKSRKS

SEQ ID NO: 263 - protein, 168 aa, Artificial Sequence
  recombinant ferritin subunit
MLSKDIIKLLNEQVNKEMQSSNLYMSMSSWCYTHSLDGAGLFLFDHAAEEYEHAKKLIIFLNCNNVPVQLTGCISAPEHKFEGLTQIFQKAYEHEQHISESINNIVDHAIKSKDHATFNFLQWYVAEQHEEECLFKDILDKIELIGNENHGLYLADQYVKGIAKSRKS

SEQ ID NO: 264 - protein, 167 aa, Artificial Sequence
  recombinant ferritin subunit
MLSKDIIKLLNEQVNKEMQSSNLYMSMSSWCYTHSLDGAGLFLFDHAAEEYEHAKKLIIFLNCNNVPVQLTCISCPEHKFEGLTQIFQKAYEHEQHISESINNIVDHAIKSKDHATFNFLQWYVAEQHEEECLFKDILDKIELIGNENHGLYLADQYVKGIAKSRKS

SEQ ID NO: 265 - protein, 167 aa, Artificial Sequence
  recombinant ferritin subunit
MLSKDIIKLLNEQVNKEMQSSNLYMSMSSWCYTHSLDGAGLFLFDHAAEEYEHAKKLIIFLNCNNVPVQLTSCSAPEHKFEGLTQIFQKAYEHEQHISESINNIVDHAIKSKDHATFNFLQWYVAEQHEEECLFKDILDKIELIGNENHGLYLADQYVKGIAKSRKS

SEQ ID NO: 266 - protein, 167 aa, Artificial Sequence
  recombinant ferritin subunit
MLSKDIIKLLNEQVNKEMQSSNLYMSMSCWCYTHSLDGAGLFLFDHAAEEYEHAKKLIIFLNENNVPCQLTSISAPEHKFEGLTQIFQKAYEHEQHISESINNICDHAIKSKDCATFNFLQWYVAEQHEEEVLFKDILDKIELIGNENHGLYLADQYVKGIAKSRKS

SEQ ID NO: 267 - protein, 168 aa, Artificial Sequence
  recombinant ferritin subunit
MLSKDIIKLLNEQVNKEMQSSNLYMSMSSWCYTHSLDGAGLFLFDHAAEEYEHAKKLIIFLNENNVPVQLTGCISAPEHKFEGLTQIFQKAYEHEQHISESINNICDHAIKSKDCATFNFLQWYVAEQHEEEVLFKDILDKIELIGNENHGLYLADQYVKGIAKSRKS

SEQ ID NO: 268 - protein, 167 aa, Artificial Sequence
  recombinant ferritin subunit
MLSKDIIKLLNEQVNKEMQSSNLYMSMSSWCYTHSLDGAGLFLFDHAAEEYEHAKKLIIFLNENNVPVQLTCISCPEHKFEGLTQIFQKAYEHEQHISESINNICDHAIKSKDCATFNFLQWYVAEQHEEEVLFKDILDKIELIGNENHGLYLADQYVKGIAKSRKS

SEQ ID NO: 269 - protein, 167 aa, Artificial Sequence
  recombinant ferritin subunit
MLSKDIIKLLNEQVNKEMQSSNLYMSMSSWCYTHSLDGAGLFLFDHAAEEYEHAKKLIIFLNENNVPVQLTSCSAPEHKFEGLTQIFQKAYEHEQHISESINNICDHAIKSKDCATFNFLQWYVAEQHEEEVLFKDILDKIELIGNENHGLYLADQYVKGIAKSRKS

SEQ ID NO: 270 - protein, 174 aa, Artificial Sequence
  recombinant ferritin subunit
MLSERMLKALNDQLNRELYSAYLYFAMACYFEDLGLEGFANWMKAQAEEEIGHALRFYNYIYCRNGRCELDEIPKPPKEWESPLKAFEAAYEHEKFISKSIYELAALAEEEKDYSTRAFLEWFINEQVEEECSVKKILDKLKFAKDSPQILFMLDKELSARAPKLPGLLMQGGE

SEQ ID NO: 271 - protein, 174 aa, Artificial Sequence
  recombinant ferritin subunit
MLSERMLKALNDQLNRELYSAYLYFAMAAYFEDLGLEGFANWMKAQAEEEIGHALRFYNYIYCRNGRVELDCIPCPPKEWESPLKAFEAAYEHEKFISKSIYELAALAEEEKDYSTRAFLEWFINEQVEEECSVKKILDKLKFAKDSPQILFMLDKELSARAPKLPGLLMQGGE

SEQ ID NO: 272 - protein, 174 aa, Artificial Sequence
  recombinant ferritin subunit
MLSERMLKALNDQLNRELYSAYLYFAMAAYFEDLGLEGFANWMKAQAEEEIGHALRFYNYIYCRNGRVELDECPKPPKEWESPLKAFEAAYEHEKFISKSIYELAALAEEEKDYSTRAFLEWFINEQVEEECSVKKILDKLKFAKDSPQILFMLDKELSARAPKLPGLLMQGGE

SEQ ID NO: 273 - protein, 174 aa, Artificial Sequence
  recombinant ferritin subunit
MLSERMLKALNDQLNRELYSAYLYFAMAAYFEDLGLEGFANWMKAQAEEEIGHALRFYNYIYCRNGRVELDCIPKPPKEWESPLKAFEAAYEHEKFISKSIYELAALAEEEKDYSTRAFLEWFINEQVEEECSVKKILDKLKFAKDSPQILFMLDKELSARAPKLPGLLMQGGE

SEQ ID NO: 274 - protein, 175 aa, Artificial Sequence
  recombinant ferritin subunit
MLSERMLKALNDQLNRELYSAYLYFAMAAYFEDLGLEGFANWMKAQAEEEIGHALRFYNYIYCRNGRVELDGCIPKPPKEWESPLKAFEAAYEHEKFISKSIYELAALAEEEKDYSTRAFLEWFINEQVEEECSVKKILDKLKFAKDSPQILFMLDKELSARAPKLPGLLMQGGE

SEQ ID NO: 275 - protein, 170 aa, Artificial Sequence
  recombinant ferritin subunit
MLSERMLKALNDQLNRELYSAYLYFAMAAYFEDLGLEGFANWMKAQAEEEIGHALRFYNYIYCRNGRVELDEIPKPPKEWESPLKAFEAAYEHEKFISKSIYELAALAEEEKDYSTRAFLEWFINEQVEEECSVKKILDKLKFAKDSPQILFMLDKELSARAPKLPGGGC

SEQ ID NO: 276 - protein, 171 aa, Artificial Sequence
  recombinant ferritin subunit
MLSERMLKALNDQLNRELYSAYLYFAMAAYFEDLGLEGFANWMKAQAEEEIGHALRFYNYIYCRNGRVELDEIPKPPKEWESPLKAFEAAYEHEKFISKSIYELAALAEEEKDYSTRAFLEWFINEQVEEECSVKKILDKLKFAKDSPQILFMLDKELSARAPKLPGGGWC

SEQ ID NO: 277 - protein, 174 aa, Artificial Sequence
  recombinant ferritin subunit
MLSERMLKALNDQLNRELYSAYLYFAMACYFEDLGLEGFANWMKAQAEEEIGHALRFYNYIYDRNGRCELDEIPKPPKEWESPLKAFEAAYEHEKFISKSIYELAALAEEEKDCSTRAFLEWFCNEQVEEEASVKKILDKLKFAKDSPQILFMLDKELSARAPKLPGLLMQGGE

SEQ ID NO: 278 - protein, 174 aa, Artificial Sequence
  recombinant ferritin subunit
MLSERMLKALNDQLNRELYSAYLYFAMAAYFEDLGLEGFANWMKAQAEEEIGHALRFYNYIYDRNGRVELDCIPCPPKEWESPLKAFEAAYEHEKFISKSIYELAALAEEEKDCSTRAFLEWFCNEQVEEEASVKKILDKLKFAKDSPQILFMLDKELSARAPKLPGLLMQGGE

SEQ ID NO: 279 - protein, 174 aa, Artificial Sequence
  recombinant ferritin subunit
MLSERMLKALNDQLNRELYSAYLYFAMAAYFEDLGLEGFANWMKAQAEEEIGHALRFYNYIYDRNGRVELDECPKPPKEWESPLKAFEAAYEHEKFISKSIYELAALAEEEKDCSTRAFLEWFCNEQVEEEASVKKILDKLKFAKDSPQILFMLDKELSARAPKLPGLLMQGGE

SEQ ID NO: 280 - protein, 174 aa, Artificial Sequence
  recombinant ferritin subunit
MLSERMLKALNDQLNRELYSAYLYFAMAAYFEDLGLEGFANWMKAQAEEEIGHALRFYNYIYDRNGRVELDCIPKPPKEWESPLKAFEAAYEHEKFISKSIYELAALAEEEKDCSTRAFLEWFCNEQVEEEASVKKILDKLKFAKDSPQILFMLDKELSARAPKLPGLLMQGGE

SEQ ID NO: 281 - protein, 175 aa, Artificial Sequence
  recombinant ferritin subunit
MLSERMLKALNDQLNRELYSAYLYFAMAAYFEDLGLEGFANWMKAQAEEEIGHALRFYNYIYDRNGRVELDGCIPKPPKEWESPLKAFEAAYEHEKFISKSIYELAALAEEEKDCSTRAFLEWFCNEQVEEEASVKKILDKLKFAKDSPQILFMLDKELSARAPKLPGLLMQGGE

SEQ ID NO: 282 - protein, 170 aa, Artificial Sequence
  recombinant ferritin subunit
MLSERMLKALNDQLNRELYSAYLYFAMAAYFEDLGLEGFANWMKAQAEEEIGHALRFYNYIYDRNGRVELDEIPKPPKEWESPLKAFEAAYEHEKFISKSIYELAALAEEEKDCSTRAFLEWFCNEQVEEEASVKKILDKLKFAKDSPQILFMLDKELSARAPKLPGGGC

SEQ ID NO: 283 - protein, 171 aa, Artificial Sequence
  recombinant ferritin subunit
MLSERMLKALNDQLNRELYSAYLYFAMAAYFEDLGLEGFANWMKAQAEEEIGHALRFYNYIYDRNGRVELDEIPKPPKEWESPLKAFEAAYEHEKFISKSIYELAALAEEEKDCSTRAFLEWFCNEQVEEEASVKKILDKLKFAKDSPQILFMLDKELSARAPKLPGGGWC

SEQ ID NO: 284 - protein, 181 aa, Artificial Sequence
  recombinant ferritin subunit
MTEYEGPKTKFHALMQEQIHNEFTAAQQYVCIAVYFDSEDLPQLAKHFYSQAVEERNHAMMLVQHLLCRDLRVECPGVDTVRNQFDRPREALALALDQERTVTDQVGRLTAVARDEGDFLGEQFMQWFLQEQIEEVCLMATLVRVADRAGANLFELENFVAREVDVAPAASGAPHAAGGRL

SEQ ID NO: 285 - protein, 181 aa, Artificial Sequence
  recombinant ferritin subunit
MTEYEGPKTKFHALMQEQIHNEFTAAQQYVAIAVYFDSEDLPQLAKHFYSQAVEERNHAMMLVQHLLCRDLRVEIPGCDTVRNQFDRPREALALALDQERTVTDQVGRLTAVARDEGDFLGEQFMQWFLQEQIEEVCLMATLVRVADRAGANLFELENFVAREVDVAPAASGAPHAAGGRL

SEQ ID NO: 286 - protein, 181 aa, Artificial Sequence
  recombinant ferritin subunit
MTEYEGPKTKFHALMQEQIHNEFTAAQQYVAIAVYFDSEDLPQLAKHFYSQAVEERNHAMMLVQHLLCRDLRVCIPGVDTVRCQFDRPREALALALDQERTVTDQVGRLTAVARDEGDFLGEQFMQWFLQEQIEEVCLMATLVRVADRAGANLFELENFVAREVDVAPAASGAPHAAGGRL

SEQ ID NO: 287 - protein, 181 aa, Artificial Sequence
  recombinant ferritin subunit
MTEYEGPKTKFHALMQEQIHNEFTAAQQYVAIAVYFDSEDLPQLAKHFYSQAVEERNHAMMLVQHLLCRDLRVEIPGVDTVRNQFDRPREALALALDQERTVTDQVGRLTAVARDEGDFLGEQFMQWFLQEQIEEVCLMATLVRVADRAGANLFELENFVAREVDVAPAASGAPHAAGGRC

SEQ ID NO: 288 - protein, 182 aa, Artificial Sequence
  recombinant ferritin subunit
MTEYEGPKTKFHALMQEQIHNEFTAAQQYVAIAVYFDSEDLPQLAKHFYSQAVEERNHAMMLVQHLLCRDLRVEIPGVDTVRNQFDRPREALALALDQERTVTDQVGRLTAVARDEGDFLGEQFMQWFLQEQIEEVCLMATLVRVADRAGANLFELENFVAREVDVAPAASGAPHAAGGRGC

SEQ ID NO: 289 - protein, 181 aa, Artificial Sequence
  recombinant ferritin subunit
MTEYEGPKTKFHALMQEQIHNEFTAAQQYVCIAVYFDSEDLPQLAKHFYSQAVEERNHAMMLVQHLLDRDLRVECPGVDTVRNQFDRPREALALALDQERTVTDQVGRLCAVARDEGDCLGEQFMQWFLQEQIEEVALMATLVRVADRAGANLFELENFVAREVDVAPAASGAPHAAGGRL

SEQ ID NO: 290 - protein, 181 aa, Artificial Sequence
  recombinant ferritin subunit
MTEYEGPKTKFHALMQEQIHNEFTAAQQYVAIAVYFDSEDLPQLAKHFYSQAVEERNHAMMLVQHLLDRDLRVEIPGCDTVRNQFDRPREALALALDQERTVTDQVGRLCAVARDEGDCLGEQFMQWFLQEQIEEVALMATLVRVADRAGANLFELENFVAREVDVAPAASGAPHAAGGRL

SEQ ID NO: 291 - protein, 181 aa, Artificial Sequence
  recombinant ferritin subunit
MTEYEGPKTKFHALMQEQIHNEFTAAQQYVAIAVYFDSEDLPQLAKHFYSQAVEERNHAMMLVQHLLDRDLRVCIPGVDTVRCQFDRPREALALALDQERTVTDQVGRLCAVARDEGDCLGEQFMQWFLQEQIEEVALMATLVRVADRAGANLFELENFVAREVDVAPAASGAPHAAGGRL

SEQ ID NO: 292 - protein, 181 aa, Artificial Sequence
  recombinant ferritin subunit
MTEYEGPKTKFHALMQEQIHNEFTAAQQYVAIAVYFDSEDLPQLAKHFYSQAVEERNHAMMLVQHLLDRDLRVEIPGVDTVRNQFDRPREALALALDQERTVTDQVGRLCAVARDEGDCLGEQFMQWFLQEQIEEVALMATLVRVADRAGANLFELENFVAREVDVAPAASGAPHAAGGRC

SEQ ID NO: 293 - protein, 182 aa, Artificial Sequence
  recombinant ferritin subunit
MTEYEGPKTKFHALMQEQIHNEFTAAQQYVAIAVYFDSEDLPQLAKHFYSQAVEERNHAMMLVQHLLDRDLRVEIPGVDTVRNQFDRPREALALALDQERTVTDQVGRLCAVARDEGDCLGEQFMQWFLQEQIEEVALMATLVRVADRAGANLFELENFVAREVDVAPAASGAPHAAGGRGC

SEQ ID NO: 294 - protein, 165 aa, Artificial Sequence
  recombinant ferritin subunit
MLKPEMIEKLNEQMNLELYSSLLYQQMSAWCCYHTFEGAAAFLRRHAQEEMTHMQRLFDYLCDTGNLPRINTVESPFAEYSSLDELFQETYKHEQLITQKINELCHAAMTNQDCPTFNFLQWYVSEQHEEEKLFKSIIDKLSLAGKSGEGLYFIDKELSTLDTQN

SEQ ID NO: 295 - protein, 165 aa, Artificial Sequence
  recombinant ferritin subunit
MLKPEMIEKLNEQMNLELYSSLLYQQMSAWCSYHTFEGAAAFLRRHAQEEMTHMQRLFDYLTDTGNLPRINCVECPFAEYSSLDELFQETYKHEQLITQKINELCHAAMTNQDCPTFNFLQWYVSEQHEEEKLFKSIIDKLSLAGKSGEGLYFIDKELSTLDTQN

SEQ ID NO: 296 - protein, 165 aa, Artificial Sequence
  recombinant ferritin subunit
MLKPEMIEKLNEQMNLELYSSLLYQQMSAWCSYHTFEGAAAFLRRHAQEEMTHMQRLFDYLTDTGNLPRINTCESPFAEYSSLDELFQETYKHEQLITQKINELCHAAMTNQDCPTFNFLQWYVSEQHEEEKLFKSIIDKLSLAGKSGEGLYFIDKELSTLDTQN

SEQ ID NO: 297 - protein, 165 aa, Artificial Sequence
  recombinant ferritin subunit
MLKPEMIEKLNEQMNLELYSSLLYQQMSAWCCYHTFEGAAAFLRRHAQEEMTHMQRLFDYLCDTGNLPRINTVESPFAEYSSLDELFQETYKHEQLITQKINELAHAAMTNQDYCTFNFLQWYCSEQHEEEKLFKSIIDKLSLAGKSGEGLYFIDKELSTLDTQN

SEQ ID NO: 298 - protein, 165 aa, Artificial Sequence
  recombinant ferritin subunit
MLKPEMIEKLNEQMNLELYSSLLYQQMSAWCSYHTFEGAAAFLRRHAQEEMTHMQRLFDYLTDTGNLPRINCVECPFAEYSSLDELFQETYKHEQLITQKINELAHAAMTNQDYCTFNFLQWYCSEQHEEEKLFKSIIDKLSLAGKSGEGLYFIDKELSTLDTQN

SEQ ID NO: 299 - protein, 165 aa, Artificial Sequence
  recombinant ferritin subunit
MLKPEMIEKLNEQMNLELYSSLLYQQMSAWCSYHTFEGAAAFLRRHAQEEMTHMQRLFDYLTDTGNLPRINTCESPFAEYSSLDELFQETYKHEQLITQKINELAHAAMTNQDYCTFNFLQWYCSEQHEEEKLFKSIIDKLSLAGKSGEGLYFIDKELSTLDTQN

SEQ ID NO: 300 - protein, 165 aa, Artificial Sequence
  recombinant ferritin subunit
MLKPEMIEKLNEQMNLELYSSLLYQQMSAWCCYHTFEGAAAFLRRHAQEEMTHMQRLFDYLCDTGNLPRINTVESPFAEYSSLDELFQETYKHEQLITQKINELAHAAMTNQDYCTFNFLQWYVSEQCEEEKLFKSIIDKLSLAGKSGEGLYFIDKELSTLDTQN

SEQ ID NO: 301 - protein, 166 aa, Artificial Sequence
  recombinant ferritin subunit
MLKPEMIEKLNEQMNLELYSSLLYQQMSAWCCYHTFEGAAAFLRRHAQEEMTHMQRLFDYLCDTGNLPRINTVESPFAEYSSLDELFQETYKHEQLITQKINELAHAAMTNQDYCTFNFLQWYVSEQCGEEEKLFKSIIDKLSLAGKSGEGLYFIDKELSTLDTQN

SEQ ID NO: 302 - protein, 165 aa, Artificial Sequence
  recombinant ferritin subunit
MLKPEMIEKLNEQMNLELYSSLLYQQMSAWCSYHTFEGAAAFLRRHAQEEMTHMQRLFDYLTDTGNLPRINCVECPFAEYSSLDELFQETYKHEQLITQKINELAHAAMTNQDYCTFNFLQWYVSEQCEEEKLFKSIIDKLSLAGKSGEGLYFIDKELSTLDTQN

SEQ ID NO: 303 - protein, 166 aa, Artificial Sequence
  recombinant ferritin subunit
MLKPEMIEKLNEQMNLELYSSLLYQQMSAWCSYHTFEGAAAFLRRHAQEEMTHMQRLFDYLTDTGNLPRINCVECPFAEYSSLDELFQETYKHEQLITQKINELAHAAMTNQDYCTFNFLQWYVSEQCGEEEKLFKSIIDKLSLAGKSGEGLYFIDKELSTLDTQN

SEQ ID NO: 304 - protein, 166 aa, Artificial Sequence
  recombinant ferritin subunit
MLKPEMIEKLNEQMNLELYSSLLYQQMSAWCSYHTFEGAAAFLRRHAQEEMTHMQRLFDYLTDTGNLPRINTCESPFAEYSSLDELFQETYKHEQLITQKINELAHAAMTNQDYCTFNFLQWYVSEQCGEEEKLFKSIIDKLSLAGKSGEGLYFIDKELSTLDTQN

SEQ ID NO: 305 - protein, 176 aa, Artificial Sequence
  recombinant ferritin subunit
MVSQCRQNYHSDCEAAVNRMLNLELYASYTYSSMYCFFDRDDVALHNVAEFFKEHSHEEREHAEKFMKYQNKRGGRCVLQDIKKPERDEWGNTLEAMQAALQLEKTVNQALLDLHKLATDKVDPHLCDFLESEYLEEQVKDIKRICDFITNLKRLGLPENGMGEYLFDKHSVKESS

SEQ ID NO: 306 - protein, 153 aa, Artificial sequence
  recombinant lumazine synthase nanoparticle subunit
QIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPITFGVITADTCEQAIERAGTCHGNKGWEAALSAIEMANLFKSLR

SEQ ID NO: 307 - protein, 154 aa, Artificial sequence
  recombinant lumazine synthase nanoparticle subunit
QIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPITFGVITADTCGEQAIERAGTCHGNKGWEAALSAIEMANLFKSLR

SEQ ID NO: 308 - protein, 154 aa, Artificial sequence
  recombinant lumazine synthase nanoparticle subunit
QIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPITFGVITADTGCEQAIERAGTCHGNKGWEAALSAIEMANLFKSLR

SEQ ID NO: 309 - protein, 153 aa, Artificial sequence
  recombinant lumazine synthase nanoparticle subunit
QIYEGCLTAEGLRFGIVASRFNHALVDRLVEGAIDAIVCHGGREEDITLVRVPGSWEIPVAAGELARKENISAVIAIGVLIRGATPHFDYIASEVSKGLADLSLELRKPITFGVITADTLEQAIERAGTKHGNKGWEAALSAIEMANLFKSLR

SEQ ID NO: 310 - protein, 154 aa, Artificial sequence
  recombinant lumazine synthase nanoparticle subunit
QCYEGKLTAEGLRFGIVASRFNHALVDRLVEGAIDCIVRHGGREEDITCVRVPGSWEIPVAAGELARKEDIDAVIAIGVLCRGATPHFDYIASEVSKGLADLSLELRKPITFGVITADTLEQAIERAGTCGHGNKGWEAALSAIEMANLFKSLR

SEQ ID NO: 311 - protein, 154 aa, Artificial sequence
  recombinant lumazine synthase nanoparticle subunit
QIYCGKLTAEGLRFGIVASRFNHALVDRLVEGAIDCIVRHGGREEDITLVCVPGSWEIPVAAGELARKEDIDAVIAIGVLCRGATPHFDYIASEVSKGLADLSLELRKPITFGVITADTLEQAIERAGTCGHGNKGWEAALSAIEMANLFKSLR

SEQ ID NO: 312 - protein, 154 aa, Artificial sequence
  recombinant lumazine synthase nanoparticle subunit
QIYEGKLTAEGLRFGIVASRFNHALVDRLVEGAIDCIVRHGGREEDITLVRVPGSWEIPVAAGELARKEDIDAVIAIGVLCRGATPHFDYIASCVSKGLCDLSLELRKPITFGVITADTLEQAIERAGTCGHGNKGWEAALSAIEMANLFKSLR

SEQ ID NO: 313 - protein, 265 aa, Artificial sequence
  recombinant encapsulin nanoparticle subunit
MEFLKRSFAPLTEKQWQEIDNRAREIFKTQLYGRKFVDVEGPYGWEYAAHPLCEVEVLSDENEVVKWGLRKSLPLIELRATFTLDLWELDNLECGKPNVDLSSLEETVRKVAEFEDEVIFRGCEKSGVKGLLSFEERKIECGSTPKDLLEAIVRALSIFSKDGIEGPYTLVINTDRWINFLKEEAGHYPLEKRVEECLRGGKIITTPRIEDALVVSERGGDFKLILGQDLSIGYEDREKDAVRLFITETFTFQVVNPEALILLKF

SEQ ID NO: 314 - protein, 265 aa, Artificial sequence
  recombinant encapsulin nanoparticle subunit
MEFLKRSFAPLTEKQWQEIDNRAREIFKTQLYGRKFVDVEGPYGWEYAAHPLCEVEVLSDENEVVKWGLRKSLPLIELRATFTLDLWELDNLERGCPNVDLSSLEETVRKVAEFEDEVIFRGCEKSGVKGLLSFEERKIECGSTPKDLLEAIVRALSIFSKDGIEGPYTLVINTDRWINFLKEEAGHYPLEKRVEECLRGGKIITTPRIEDALVVSERGGDFKLILGQDLSIGYEDREKDAVRLFITETFTFQVVNPEALILLKF

SEQ ID NO: 315 - protein, 265 aa, Artificial sequence
  recombinant encapsulin nanoparticle subunit
MEFLKRSFAPLTEKQWQEIDNRAREIFKTQLYGRKFVDVEGPYGWEYAAHPLGEVEVLSDENEVVKWGLRKSLPLIELRATFTLDLWELDNLERGKPNVDLSSLEETVRKVAEFEDEVIFRGCEKSGVKGLLSFEERKIECGSTPCDLLEAIVRALSIFSKDGIEGPYTLVINTDRWINFLKEECGHYPLEKRVEECLRGGKIITTPRIEDALVVSERGGDFKLILGQDLSIGYEDREKDAVRLFITETFTFQVVNPEALILLKF

SEQ ID NO: 316 - protein, 130 aa, Artificial sequence
  recombinant AP205 nanoparticle subunit
MANKPMQPITSTANKIVWSDPTRLSTTFSASLLRQRVKVGIAELNNVSGQYVSVYKRPAPKPEGCADACVIMPNENQSIRTVISGSAENLATLKAEWETHKRNVDTLFASGNAGLGFLDPTAAIVSSDTT

SEQ ID NO: 317 - protein, 130 aa, Artificial sequence
  recombinant AP205 nanoparticle subunit
MANKPMQPITSTANKIVWSDPTRLSTTFSASLLRQRVKVGIAELNNVSGQYVSVYKRPAPKPEGCADACVIMPNENQSIRCVISGSAENLATLKAEWETHKRNVDTLFASGNAGLGFLDPTAAIVSSDTT

SEQ ID NO: 318 - protein, 130 aa, Artificial sequence
  recombinant AP205 nanoparticle subunit
MANKPMQPITSTANKIVWSDPTRLSTTFSASLLRQRVKVGIAELNNVSGQYVCVYKRPAPKPEGCADACVIMPNENQSIRTVISGSAENLATLKAEWETCKRNVDTLFASGNAGLGFLDPTAAIVSSDTT

SEQ ID NO: 319 - protein, 130 aa, Artificial sequence
  recombinant AP205 nanoparticle subunit
MANKPMQPITSTANKIVWSDPTRLSTTFSASLLRQRVKVGIAELNNVSGQYVSVYKRPAPKPEGCADACVIMPNENQSICTCISGSAENLATLKAEWETHKRNVDTLFASGNAGLGFLDPTAAIVSSDTT

SEQ ID NO: 320 - protein, 131 aa, Artificial sequence
  recombinant AP205 nanoparticle subunit
MANKPMQPITSTANKIVWSDPTRLSTTFSASLLRQRVKVGIAELNNVSGQYVSVYKRPAPKPEGCADAGCVIMPNENQSIRTVISGSAENLATLKAEWETHKRNVDTLFASGNAGLGFLDPTAAIVSSDTT

SEQ ID NO: 321 - protein, 183 aa, Artificial sequence
  recombinant HBV nanoparticle subunit
MDIDPYKEFGATVELLSFLPSDFFPSVRDLLDTASALYREALESPEHCSPHHTALRQAILCWGELMTLATWVGVNLEDPASRDLVVSYVNTNMGLKFRQLLWFHISCLTFGRETVIEYLVSFGVWIRTPPAYRPPNAPILSTLPETTVVRRRGRSPRRRTPSPRRRRSQSPRRRRSQSRESQC

SEQ ID NO: 322 - protein, 183 aa, Artificial sequence
  recombinant HBV nanoparticle subunit
MDIDPYKEFGATVELLSFLPSDFFCSVRDLLDTASALYREALESPEHCSPHHTALRQAILCWGELMTLATWVGVNLEDPASRDLVVSYVNTNMGLKFRQLLWFHISCLTFGRETVIEYLVSFGVWICTPPAYRPPNAPILSTLPETTVVRRRGRSPRRRTPSPRRRRSQSPRRRRSQSRESQC

SEQ ID NO: 323 - protein, 183 aa, Artificial sequence
  recombinant HBV nanoparticle subunit
MDIDPYKEFGATVCLLSFLPSDFFPSVRDLLDTASCLYREALESPEHCSPHHTALRQAILCWGELMTLATWVGVNLEDPASRDLVVSYVNTNMGLKFRQLLWFHISCLTFGRETVIEYLVSFGVWIRTPPAYRPPNAPILSTLPETTVVRRRGRSPRRRTPSPRRRRSQSPRRRRSQSRESQC

SEQ ID NO: 324 - protein, 183 aa, Artificial sequence
  recombinant HBV nanoparticle subunit
MDIDPYKEFGATVELLSFLPSDFFPSVRCLLDTASALYREALESPEHCSPHHTALRQAILCWGELMTLATWVGVNLEDPASRDLVVSYVNTNMGLKFRQLLWFHISCLTFGRETVIEYLVSFGVWICTPPAYRPPNAPILSTLPETTVVRRRGRSPRRRTPSPRRRRSQSPRRRRSQSRESQC

SEQ ID NO: 325 - protein, 183 aa, Artificial sequence
  recombinant HBV nanoparticle subunit
MDIDPYKEFGATVELLSCLPSDFFPSVRDLLDTASCLYREALESPEHCSPHHTALRQAILCWGELMTLATWVGVNLEDPASRDLVVSYVNTNMGLKFRQLLWFHISCLTFGRETVIEYLVSFGVWIRTPPAYRPPNAPILSTLPETTVVRRRGRSPRRRTPSPRRRRSQSPRRRRSQSRESQC

SEQ ID NO: 326 - protein, 183 aa, Artificial sequence; identical to SEQ ID NO: 324
  recombinant HBV nanoparticle subunit

SEQ ID NO: 327 - protein, 28 aa, Artificial sequence
  peptide linker
EPKIPQPQPKPQPQPQPQPKPQPKPEPE

SEQ ID NO: 328 - protein, 47 aa, Artificial sequence
  peptide linker
KPTTTPAPRPPTPAPTIASQPLSLRPEACRPAAGGAVHTRGLDFACD

SEQ ID NO: 329 - protein, 45 aa, Artificial sequence
  peptide linker
GGSGEPKSDKTHTPPPAPELLGSGEPKSDKTHTPPPAPELLGSGG

SEQ ID NO: 330 - protein, 10 aa, Artificial sequence
  peptide linker
GGGGSGGGGS

SEQ ID NO: 331 - protein, 641 aa, Artificial sequence
  recombinant nanoparticle carrier subunit
QIYEGCLTAEGLRFGIVASRFNHALVDRLVEGAIDAIVCHGGREEDITLVRVPGSWEIPVAAGELARKENISAVIAIGVLIRGATPHFDYIASEVSKGLADLSLELRKPITFGVITADTLEQAIERAGTKHGNKGWEAALSAIEMANLFKSLRGSGGSEPKIPQPQPKPQPQPQPQPKPQPKPEPEGSGMKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 332 - protein, 641 aa, Artificial sequence
  recombinant nanoparticle carrier subunit
QIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPITFGVITADTCEQAIERAGTCHGNKGWEAALSAIEMANLFKSLRGSGGSEPKIPQPQPKPQPQPQPQPKPQPKPEPEGSGMKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 333 - protein, 642 aa, Artificial sequence
  recombinant nanoparticle carrier subunit
QIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPITFGVITADTCEQAIERAGTCGHGNKGWEAALSAIEMANLFKSLRGSGGSEPKIPQPQPKPQPQPQPQPKPQPKPEPEGSGMKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 334 - protein, 642 aa, Artificial sequence
  recombinant nanoparticle carrier subunit
QIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPITFGVITADTCEQAIERAGTGCHGNKGWEAALSAIEMANLFKSLRGSGGSEPKIPQPQPKPQPQPQPQPKPQPKPEPEGSGMKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 335 - protein, 642 aa, Artificial sequence
  recombinant nanoparticle carrier subunit
QIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPITFGVITADTCGEQAIERAGTCHGNKGWEAALSAIEMANLFKSLRGSGGSEPKIPQPQPKPQPQPQPQPKPQPKPEPEGSGMKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 336 - protein, 642 aa, Artificial sequence
  recombinant nanoparticle carrier subunit
QIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPITFGVITADTGCEQAIERAGTCHGNKGWEAALSAIEMANLFKSLRGSGGSEPKIPQPQPKPQPQPQPQPKPQPKPEPEGSGMKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 337 - protein, 652 aa, Artificial sequence
  recombinant nanoparticle carrier subunit
QIYEGCLTAEGLRFGIVASRFNHALVDRLVEGAIDAIVCHGGREEDITLVRVPGSWEIPVAAGELARKENISAVIAIGVLIRGATPHFDYIASEVSKGLADLSLELRKPITFGVITADTLEQAIERAGTKHGNKGWEAALSAIEMANLFKSLRGSGKPTTTPAPRPPTPAPTIASQPLSLRPEATRPAAGGAVHTRGGSGMKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 338 - protein, 652 aa, Artificial sequence
  recombinant nanoparticle carrier subunit
QIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPITFGVITADTCEQAIERAGTCHGNKGWEAALSAIEMANLFKSLRGSGKPTTTPAPRPPTPAPTIASQPLSLRPEATRPAAGGAVHTRGGSGMKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 339 - protein, 653 aa, Artificial sequence
  recombinant nanoparticle carrier subunit
QIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPITFGVITADTCEQAIERAGTCGHGNKGWEAALSAIEMANLFKSLRGSGKPTTTPAPRPPTPAPTIASQPLSLRPEATRPAAGGAVHTRGGSGMKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 340 - protein, 653 aa, Artificial sequence
  recombinant nanoparticle carrier subunit
QIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPITFGVITADTCEQAIERAGTGCHGNKGWEAALSAIEMANLFKSLRGSGKPTTTPAPRPPTPAPTIASQPLSLRPEATRPAAGGAVHTRGGSGMKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 341 - protein, 653 aa, Artificial sequence
  recombinant nanoparticle carrier subunit
QIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPITFGVITADTCGEQAIERAGTCHGNKGWEAALSAIEMANLFKSLRGSGKPTTTPAPRPPTPAPTIASQPLSLRPEATRPAAGGAVHTRGGSGMKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 342 - protein, 653 aa, Artificial sequence
  recombinant nanoparticle carrier subunit
QIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPITFGVITADTGCEQAIERAGTCHGNKGWEAALSAIEMANLFKSLRGSGKPTTTPAPRPPTPAPTIASQPLSLRPEATRPAAGGAVHTRGGSGMKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 343 - protein, 658 aa, Artificial sequence
  recombinant nanoparticle carrier subunit
QIYEGCLTAEGLRFGIVASRFNHALVDRLVEGAIDAIVCHGGREEDITLVRVPGSWEIPVAAGELARKENISAVIAIGVLIRGATPHFDYIASEVSKGLADLSLELRKPITFGVITADTLEQAIERAGTKHGNKGWEAALSAIEMANLFKSLRGSGKPTTTPAPRPPTPAPTIASQPLSLRPEACRPAAGGAVHTRGLDFACDGSGMKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 344 - protein, 658 aa, Artificial sequence
  recombinant nanoparticle carrier subunit
QIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPITFGVITADTCEQAIERAGTCHGNKGWEAALSAIEMANLFKSLRGSGKPTTTPAPRPPTPAPTIASQPLSLRPEACRPAAGGAVHTRGLDFACDGSGMKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 345 - protein, 659 aa, Artificial sequence
  recombinant nanoparticle carrier subunit
QIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPITFGVITADTCEQAIERAGTCGHGNKGWEAALSAIEMANLFKSLRGSGKPTTTPAPRPPTPAPTIASQPLSLRPEACRPAAGGAVHTRGLDFACDGSGMKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 346 - protein, 659 aa, Artificial sequence
  recombinant nanoparticle carrier subunit
QIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPITFGVITADTCEQAIERAGTGCHGNKGWEAALSAIEMANLFKSLRGSGKPTTTPAPRPPTPAPTIASQPLSLRPEACRPAAGGAVHTRGLDFACDGSGMKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 347 - protein, 659 aa, Artificial sequence
  recombinant nanoparticle carrier subunit
QIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPITFGVITADTCGEQAIERAGTCHGNKGWEAALSAIEMANLFKSLRGSGKPTTTPAPRPPTPAPTIASQPLSLRPEACRPAAGGAVHTRGLDFACDGSGMKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 348 - protein, 659 aa, Artificial sequence
  recombinant nanoparticle carrier subunit
QIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPITFGVITADTGCEQAIERAGTCHGNKGWEAALSAIEMANLFKSLRGSGKPTTTPAPRPPTPAPTIASQPLSLRPEACRPAAGGAVHTRGLDFACDGSGMKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 349 - protein, 650 aa, Artificial sequence
  recombinant nanoparticle carrier subunit
QIYEGCLTAEGLRFGIVASRFNHALVDRLVEGAIDAIVCHGGREEDITLVRVPGSWEIPVAAGELARKENISAVIAIGVLIRGATPHFDYIASEVSKGLADLSLELRKPITFGVITADTLEQAIERAGTKHGNKGWEAALSAIEMANLFKSLRGGSGEPKSDKTHTPPPAPELLGSGEPKSDKTHTPPPAPELLGSGGMKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 350 - protein, 650 aa, Artificial sequence
  recombinant nanoparticle carrier subunit
QIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPITFGVITADTCEQAIERAGTCHGNKGWEAALSAIEMANLFKSLRGGSGEPKSDKTHTPPPAPELLGSGEPKSDKTHTPPPAPELLGSGGMKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 351 - protein, 651 aa, Artificial sequence
  recombinant nanoparticle carrier subunit
QIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPITFGVITADTCEQAIERAGTCGHGNKGWEAALSAIEMANLFKSLRGGSGEPKSDKTHTPPPAPELLGSGEPKSDKTHTPPPAPELLGSGGMKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 352 - protein, 651 aa, Artificial sequence
  recombinant nanoparticle carrier subunit
QIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPITFGVITADTCEQAIERAGTGCHGNKGWEAALSAIEMANLFKSLRGGSGEPKSDKTHTPPPAPELLGSGEPKSDKTHTPPPAPELLGSGGMKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 353 - protein, 651 aa, Artificial sequence
  recombinant nanoparticle carrier subunit
QIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPITFGVITADTCGEQAIERAGTCHGNKGWEAALSAIEMANLFKSLRGGSGEPKSDKTHTPPPAPELLGSGEPKSDKTHTPPPAPELLGSGGMKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 354 - protein, 651 aa, Artificial sequence
  recombinant nanoparticle carrier subunit
QIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPITFGVITADTGCEQAIERAGTCHGNKGWEAALSAIEMANLFKSLRGGSGEPKSDKTHTPPPAPELLGSGEPKSDKTHTPPPAPELLGSGGMKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 355 - protein, 620 aa, Artificial sequence
  recombinant nanoparticle carrier subunit
QIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPITFGVITADTLEQAIERAGTKHGNKGWEAALSAIEMANLFKSLRGGGGSGGGGSGGGGSMKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 356 - protein, 630 aa, Artificial sequence
  recombinant nanoparticle carrier subunit
QIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPITFGVITADTLEQAIERAGTKHGNKGWEAALSAIEMANLFKSLRGGKSGGNKKSDGVKESSESGGGSGGMKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 357 - protein, 635 aa, Artificial sequence
  recombinant nanoparticle carrier subunit
QIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPITFGVITADTLEQAIERAGTKHGNKGWEAALSAIEMANLFKSLRGGGGSGGKSGGNKKSDGVKESSESGGGSGGMKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 358 - protein, 640 aa, Artificial sequence
  recombinant nanoparticle carrier subunit
QIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPITFGVITADTLEQAIERAGTKHGNKGWEAALSAIEMANLFKSLRGGGGSGGKSGGNKKSDGVKESSESGGGSGGGGGGSMKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 359 - protein, 649 aa, Artificial sequence
  recombinant nanoparticle carrier subunit
QIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPITFGVITADTLEQAIERAGTKHGNKGWEAALSAIEMANLFKSLRGGKSGGNKKSDGVKSLVRAENLWVTVYYGVPVWSLVRGESSESGMKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 360 - protein, 647 aa, Artificial sequence
  recombinant nanoparticle carrier subunit
QIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPITFGVITADTLEQAIERAGTKHGNKGWEAALSAIEMANLFKSLRGGKSGGNKKSDGVKESLVRAKFVAAWTLKAAAGSLVRSSESGMKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 361 - protein, 628 aa, Artificial sequence
  recombinant nanoparticle carrier subunit
QIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPITFGVITADTLEQAIERAGTKHGNKGWEAALSAIEMANLFKSLRGGEPKSCDKTHTCPPCPAPELLGGKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 362 - protein, 625 aa, Artificial sequence
  recombinant nanoparticle carrier subunit
QIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPITFGVITADTLEQAIERAGTKHGNKGWEAALSAIEMANLFKSLRGGEPKSDKTHTPPPAPELLGGKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 363 - protein, 650 aa, Artificial sequence
  recombinant nanoparticle carrier subunit
QIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPITFGVITADTLEQAIERAGTKHGNKGWEAALSAIEMANLFKSLRGGSGEPKSDKTHTPPPAPELLGSGEPKSDKTHTPPPAPELLGSGGMKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 364 - protein, 628 aa, Artificial sequence
  recombinant nanoparticle carrier subunit
QIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPITFGVITADTLEQAIERAGTKHGNKGWEAALSAIEMANLFKSLRGGEPKSTDKTHTSPPSPAPELLGGKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 365 - protein, 630 aa, Artificial sequence
  recombinant nanoparticle carrier subunit
QIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPITFGVITADTLEQAIERAGTKHGNKGWEAALSAIEMANLFKSLRGGITELKKLESKINKVFSTPIPFSYSKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 366 - protein, 641 aa, Artificial sequence
  recombinant nanoparticle carrier subunit
QIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPITFGVITADTLEQAIERAGTKHGNKGWEAALSAIEMANLFKSLRGSGGSEPKIPQPQPKPQPQPQPQPKPQPKPEPEGSGMKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 367 - protein, 652 aa, Artificial sequence
  recombinant nanoparticle carrier subunit
QIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPITFGVITADTLEQAIERAGTKHGNKGWEAALSAIEMANLFKSLRGSGKPTTTPAPRPPTPAPTIASQPLSLRPEATRPAAGGAVHTRGGSGMKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 368 - protein, 658 aa, Artificial sequence
  recombinant nanoparticle carrier subunit
QIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPITFGVITADTLEQAIERAGTKHGNKGWEAALSAIEMANLFKSLRGSGKPTTTPAPRPPTPAPTIASQPLSLRPEACRPAAGGAVHTRGLDFACDGSGMKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 369 - protein, 728 aa, Artificial sequence
  recombinant nanoparticle carrier subunit
MEFLKRSFAPLTEKQWQEIDNRAREIFKTQLYGRKFVDVEGPYGWEYAAHPLCEVEVLSDENEVVKWGLRKSLPLIELRATFTLDLWELDNLECGKPNVDLSSLEETVRKVAEFEDEVIFRGCEKSGVKGLLSFEERKIECGSTPKDLLEAIVRALSIFSKDGIEGPYTLVINTDRWINFLKEEAGHYPLEKRVEECLRGGKIITTPRIEDALVVSERGGDFKLILGQDLSIGYEDREKDAVRLFITETFTFQVVNPEALILLKFGGGSGGGSGGGSKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 370 - protein, 479 aa, Artificial sequence
  recombinant nanoparticle carrier subunit
MEFLKRSFAPLTEKQWQEIDNRAREIFKTQLYGRKFVDVEGPYGWEYAAHPLCEVEVLSDENEVVKWGLRKSLPLIELRATFTLDLWELDNLECGKPNVDLSSLEETVRKVAEFEDEVIFRGCEKSGVKGLLSFEERKIECGSTPKDLLEAIVRALSIFSKDGIEGPYTLVINTDRWINFLKEEAGHYPLEKRVEECLRGGKIITTPRIEDALVVSERGGDFKLILGQDLSIGYEDREKDAVRLFITETFTFQVVNPEALILLKFGGGSGGGSGGGSLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 371 - protein, 525 aa, Artificial sequence
  recombinant nanoparticle carrier subunit
MEFLKRSFAPLTEKQWQEIDNRAREIFKTQLYGRKFVDVEGPYGWEYAAHPLCEVEVLSDENEVVKWGLRKSLPLIELRATFTLDLWELDNLECGKPNVDLSSLEETVRKVAEFEDEVIFRGCEKSGVKGLLSFEERKIECGSTPKDLLEAIVRALSIFSKDGIEGPYTLVINTDRWINFLKEEAGHYPLEKRVEECLRGGKIITTPRIEDALVVSERGGDFKLILGQDLSIGYEDREKDAVRLFITETFTFQVVNPEALILLKFGGGSGGGSGGGSKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSIT

SEQ ID NO: 372 - protein, 470 aa, Artificial sequence
  recombinant nanoparticle carrier subunit
MEFLKRSFAPLTEKQWQEIDNRAREIFKTQLYGRKFVDVEGPYGWEYAAHPLCEVEVLSDENEVVKWGLRKSLPLIELRATFTLDLWELDNLECGKPNVDLSSLEETVRKVAEFEDEVIFRGCEKSGVKGLLSFEERKIECGSTPKDLLEAIVRALSIFSKDGIEGPYTLVINTDRWINFLKEEAGHYPLEKRVEECLRGGKIITTPRIEDALVVSERGGDFKLILGQDLSIGYEDREKDAVRLFITETFTFQVVNPEALILLKFGGGSGGGSGGGSKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAE

SEQ ID NO: 373 - protein, 363 aa, Artificial sequence
  recombinant nanoparticle carrier subunit
MEFLKRSFAPLTEKQWQEIDNRAREIFKTQLYGRKFVDVEGPYGWEYAAHPLCEVEVLSDENEVVKWGLRKSLPLIELRATFTLDLWELDNLECGKPNVDLSSLEETVRKVAEFEDEVIFRGCEKSGVKGLLSFEERKIECGSTPKDLLEAIVRALSIFSKDGIEGPYTLVINTDRWINFLKEEAGHYPLEKRVEECLRGGKIITTPRIEDALVVSERGGDFKLILGQDLSIGYEDREKDAVRLFITETFTFQVVNPEALILLKFGGGSGGGSGGGSKNLDCWVDNEEDIDVILKKSTILNLDINNDIISDISGFNSSVITYPDAQLVPGINGKAIHLVNNESSEVIVHKAMDIEYNDMFNNF

SEQ ID NO: 374 - protein, 363 aa, Artificial sequence
  recombinant nanoparticle carrier subunit
MEFLKRSFAPLTEKQWQEIDNRAREIFKTQLYGRKFVDVEGPYGWEYAAHPLCEVEVLSDENEVVKWGLRKSLPLIELRATFTLDLWELDNLERGCPNVDLSSLEETVRKVAEFEDEVIFRGCEKSGVKGLLSFEERKIECGSTPKDLLEAIVRALSIFSKDGIEGPYTLVINTDRWINFLKEEAGHYPLEKRVEECLRGGKIITTPRIEDALVVSERGGDFKLILGQDLSIGYEDREKDAVRLFITETFTFQVVNPEALILLKFGGGSGGGSGGGSKNLDCWVDNEEDIDVILKKSTILNLDINNDIISDISGFNSSVITYPDAQLVPGINGKAIHLVNNESSEVIVHKAMDIEYNDMFNNF

SEQ ID NO: 375 - protein, 363 aa, Artificial sequence
  recombinant nanoparticle carrier subunit
MEFLKRSFAPLTEKQWQEIDNRAREIFKTQLYGRKFVDVEGPYGWEYAAHPLGEVEVLSDENEVVKWGLRKSLPLIELRATFTLDLWELDNLERGKPNVDLSSLEETVRKVAEFEDEVIFRGCEKSGVKGLLSFEERKIECGSTPCDLLEAIVRALSIFSKDGIEGPYTLVINTDRWINFLKEECGHYPLEKRVEECLRGGKIITTPRIEDALVVSERGGDFKLILGQDLSIGYEDREKDAVRLFITETFTFQVVNPEALILLKFGGGSGGGSGGGSKNLDCWVDNEEDIDVILKKSTILNLDINNDIISDISGFNSSVITYPDAQLVPGINGKAIHLVNNESSEVIVHKAMDIEYNDMFNNF

SEQ ID NO: 376 - protein, 383 aa, Artificial sequence
  recombinant nanoparticle carrier subunit
MEFLKRSFAPLTEKQWQEIDNRAREIFKTQLYGRKFVDVEGPYGWEYAAHPLCEVEVLSDENEVVKWGLRKSLPLIELRATFTLDLWELDNLECGKPNVDLSSLEETVRKVAEFEDEVIFRGCEKSGVKGLLSFEERKIECGSTPKDLLEAIVRALSIFSKDGIEGPYTLVINTDRWINFLKEEAGHYPLEKRVEECLRGGKIITTPRIEDALVVSERGGDFKLILGQDLSIGYEDREKDAVRLFITETFTFQVVNPEALILLKFGGEPKIPQPQPKPQPQPQPQPKPQPKPEPEGGKNLDCWVDNEEDIDVILKKSTILNLDINNDIISDISGFNSSVITYPDAQLVPGINGKAIHLVNNESSEVIVHKAMDIEYNDMFNNF

SEQ ID NO: 377 - protein, 402 aa, Artificial sequence
  recombinant nanoparticle carrier subunit
MEFLKRSFAPLTEKQWQEIDNRAREIFKTQLYGRKFVDVEGPYGWEYAAHPLCEVEVLSDENEVVKWGLRKSLPLIELRATFTLDLWELDNLECGKPNVDLSSLEETVRKVAEFEDEVIFRGCEKSGVKGLLSFEERKIECGSTPKDLLEAIVRALSIFSKDGIEGPYTLVINTDRWINFLKEEAGHYPLEKRVEECLRGGKIITTPRIEDALVVSERGGDFKLILGQDLSIGYEDREKDAVRLFITETFTFQVVNPEALILLKFGGKPTTTPAPRPPTPAPTIASQPLSLRPEACRPAAGGAVHTRGLDFACDGGKNLDCWVDNEEDIDVILKKSTILNLDINNDIISDISGFNSSVITYPDAQLVPGINGKAIHLVNNESSEVIVHKAMDIEYNDMFNNF

SEQ ID NO: 378 - protein, 392 aa, Artificial sequence
  recombinant nanoparticle carrier subunit
MEFLKRSFAPLTEKQWQEIDNRAREIFKTQLYGRKFVDVEGPYGWEYAAHPLCEVEVLSDENEVVKWGLRKSLPLIELRATFTLDLWELDNLECGKPNVDLSSLEETVRKVAEFEDEVIFRGCEKSGVKGLLSFEERKIECGSTPKDLLEAIVRALSIFSKDGIEGPYTLVINTDRWINFLKEEAGHYPLEKRVEECLRGGKIITTPRIEDALVVSERGGDFKLILGQDLSIGYEDREKDAVRLFITETFTFQVVNPEALILLKFGGEPKSDKTHTPPPAPELLGSGEPKSDKTHTPPPAPELLGGKNLDCWVDNEEDIDVILKKSTILNLDINNDIISDISGFNSSVITYPDAQLVPGINGKAIHLVNNESSEVIVHKAMDIEYNDMFNNF

SEQ ID NO: 379 - protein, 679 aa, Artificial sequence
  recombinant nanoparticle carrier subunit
KNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTNDGGSGEPKSDKTHTPPPAPELLGSGEPKSDKTHTPPPAPELLGSGGMDIDPYKEFGATVELLSFLPSDFFCSVRDLLDTASALYREALESPEHCSPHHTALRQAILCWGELMTLATWVGVNLEDPASRDLVVSYVNTNMGLKFRQLLWFHISCLTFGRETVIEYLVSFGVWICTPPAYRPPNAPILSTLPETTVVRRRGRSPRRRTPSPRRRRSQSPRRRRSQSRESQC

SEQ ID NO: 380 - protein, 679 aa, Artificial sequence
  recombinant nanoparticle carrier subunit
KNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTNDGGSGEPKSDKTHTPPPAPELLGSGEPKSDKTHTPPPAPELLGSGGMDIDPYKEFGATVCLLSFLPSDFFPSVRDLLDTASCLYREALESPEHCSPHHTALRQAILCWGELMTLATWVGVNLEDPASRDLVVSYVNTNMGLKFRQLLWFHISCLTFGRETVIEYLVSFGVWIRTPPAYRPPNAPILSTLPETTVVRRRGRSPRRRTPSPRRRRSQSPRRRRSQSRESQC

SEQ ID NO: 381 - protein, 679 aa, Artificial sequence
  recombinant nanoparticle carrier subunit
KNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTNDGGSGEPKSDKTHTPPPAPELLGSGEPKSDKTHTPPPAPELLGSGGMDIDPYKEFGATVELLSFLPSDFFPSVRCLLDTASALYREALESPEHCSPHHTALRQAILCWGELMTLATWVGVNLEDPASRDLVVSYVNTNMGLKFRQLLWFHISCLTFGRETVIEYLVSFGVWICTPPAYRPPNAPILSTLPETTVVRRRGRSPRRRTPSPRRRRSQSPRRRRSQSRESQC

SEQ ID NO: 382 - protein, 670 aa, Artificial sequence
  recombinant nanoparticle carrier subunit
KNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTNDGSGGSEPKIPQPQPKPQPQPQPQPKPQPKPEPEGSGMDIDPYKEFGATVELLSFLPSDFFCSVRDLLDTASALYREALESPEHCSPHHTALRQAILCWGELMTLATWVGVNLEDPASRDLVVSYVNTNMGLKFRQLLWFHISCLTFGRETVIEYLVSFGVWICTPPAYRPPNAPILSTLPETTVVRRRGRSPRRRTPSPRRRRSQSPRRRRSQSRESQC

SEQ ID NO: 383 - protein, 670 aa, Artificial sequence
  recombinant nanoparticle carrier subunit
KNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTNDGSGGSEPKIPQPQPKPQPQPQPQPKPQPKPEPEGSGMDIDPYKEFGATVCLLSFLPSDFFPSVRDLLDTASCLYREALESPEHCSPHHTALRQAILCWGELMTLATWVGVNLEDPASRDLVVSYVNTNMGLKFRQLLWFHISCLTFGRETVIEYLVSFGVWIRTPPAYRPPNAPILSTLPETTVVRRRGRSPRRRTPSPRRRRSQSPRRRRSQSRESQC

SEQ ID NO: 384 - protein, 670 aa, Artificial sequence
  recombinant nanoparticle carrier subunit
KNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTNDGSGGSEPKIPQPQPKPQPQPQPQPKPQPKPEPEGSGMDIDPYKEFGATVELLSFLPSDFFPSVRCLLDTASALYREALESPEHCSPHHTALRQAILCWGELMTLATWVGVNLEDPASRDLVVSYVNTNMGLKFRQLLWFHISCLTFGRETVIEYLVSFGVWICTPPAYRPPNAPILSTLPETTVVRRRGRSPRRRTPSPRRRRSQSPRRRRSQSRESQC

SEQ ID NO: 385 - protein, 690 aa, Artificial sequence
  recombinant nanoparticle carrier subunit
KNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTNDGSGGSGKPTTTPAPRPPTPAPTIASQPLSLRPEACRPAAGGAVHTRGLDFACDGSGMDIDPYKEFGATVELLSFLPSDFFCSVRDLLDTASALYREALESPEHCSPHHTALRQAILCWGELMTLATWVGVNLEDPASRDLVVSYVNTNMGLKFRQLLWFHISCLTFGRETVIEYLVSFGVWICTPPAYRPPNAPILSTLPETTVVRRRGRSPRRRTPSPRRRRSQSPRRRRSQSRESQC

SEQ ID NO: 386 - protein, 690 aa, Artificial sequence
  recombinant nanoparticle carrier subunit
KNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTNDGSGGSGKPTTTPAPRPPTPAPTIASQPLSLRPEACRPAAGGAVHTRGLDFACDGSGMDIDPYKEFGATVCLLSFLPSDFFPSVRDLLDTASCLYREALESPEHCSPHHTALRQAILCWGELMTLATWVGVNLEDPASRDLVVSYVNTNMGLKFRQLLWFHISCLTFGRETVIEYLVSFGVWIRTPPAYRPPNAPILSTLPETTVVRRRGRSPRRRTPSPRRRRSQSPRRRRSQSRESQC

SEQ ID NO: 387 - protein, 690 aa, Artificial sequence
  recombinant nanoparticle carrier subunit
KNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTNDGSGGSGKPTTTPAPRPPTPAPTIASQPLSLRPEACRPAAGGAVHTRGLDFACDGSGMDIDPYKEFGATVELLSFLPSDFFPSVRCLLDTASALYREALESPEHCSPHHTALRQAILCWGELMTLATWVGVNLEDPASRDLVVSYVNTNMGLKFRQLLWFHISCLTFGRETVIEYLVSFGVWICTPPAYRPPNAPILSTLPETTVVRRRGRSPRRRTPSPRRRRSQSPRRRRSQSRESQC

SEQ ID NO: 388 - protein, 593 aa, Artificial sequence
  recombinant nanoparticle carrier subunit
MANKPMQPITSTANKIVWSDPTRLSTTFSASLLRQRVKVGIAELNNVSGQYVSVYKRPAPKPEGCADACVIMPNENQSIRTVISGSAENLATLKAEWETHKRNVDTLFASGNAGLGFLDPTAAIVSSDTTGGGSGGGSGGGSKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTND

SEQ ID NO: 389 - protein, 335 aa, Artificial sequence
  recombinant nanoparticle carrier subunit
MANKPMQPITSTANKIVWSDPTRLSTTFSASLLRQRVKVGIAELNNVSGQYVSVYKRPAPKPEGCADACVIMPNENQSIRTVISGSAENLATLKAEWETHKRNVDTLFASGNAGLGFLDPTAAIVSSDTTGGGSGGGSGGGSKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAE

SEQ ID NO: 390 - protein, 228 aa, Artificial sequence
  recombinant nanoparticle carrier subunit
MANKPMQPITSTANKIVWSDPTRLSTTFSASLLRQRVKVGIAELNNVSGQYVSVYKRPAPKPEGCADACVIMPNENQSIRTVISGSAENLATLKAEWETHKRNVDTLFASGNAGLGFLDPTAAIVSSDTTGGGSGGGSGGGSKNLDCWVDNEEDIDVILKKSTILNLDINNDIISDISGFNSSVITYPDAQLVPGINGKAIHLVNNESSEVIVHKAMDIEYNDMFNNF

SEQ ID NO: 391 - protein, 250 aa, Artificial sequence
  recombinant nanoparticle carrier subunit
MANKPMQPITSTANKIVWSDPTRLSTTFSASLLRQRVKVGIAELNNVSGQYVSVYKRPAPKPEGCADACVIMPNENQSIRTVISGSAENLATLKAEWETHKRNVDTLFASGNAGLGFLDPTAAIVSSDTTGSGEPKIPQPQPKPQPQPQPQPKPQPKPEPEGSGKNLDCWVDNEEDIDVILKKSTILNLDINNDIISDISGFNSSVITYPDAQLVPGINGKAIHLVNNESSEVIVHKAMDIEYNDMFNNF

SEQ ID NO: 392 - protein, 269 aa, Artificial sequence
  recombinant nanoparticle carrier subunit
MANKPMQPITSTANKIVWSDPTRLSTTFSASLLRQRVKVGIAELNNVSGQYVSVYKRPAPKPEGCADACVIMPNENQSIRTVISGSAENLATLKAEWETHKRNVDTLFASGNAGLGFLDPTAAIVSSDTTGSGKPTTTPAPRPPTPAPTIASQPLSLRPEACRPAAGGAVHTRGLDFACDGSGKNLDCWVDNEEDIDVILKKSTILNLDINNDIISDISGFNSSVITYPDAQLVPGINGKAIHLVNNESSEVIVHKAMDIEYNDMFNNF

SEQ ID NO: 393 - protein, 259 aa, Artificial sequence
  recombinant nanoparticle carrier subunit
MANKPMQPITSTANKIVWSDPTRLSTTFSASLLRQRVKVGIAELNNVSGQYVSVYKRPAPKPEGCADACVIMPNENQSIRTVISGSAENLATLKAEWETHKRNVDTLFASGNAGLGFLDPTAAIVSSDTTGSGEPKSDKTHTPPPAPELLGSGEPKSDKTHTPPPAPELLGSGKNLDCWVDNEEDIDVILKKSTILNLDINNDIISDISGFNSSVITYPDAQLVPGINGKAIHLVNNESSEVIVHKAMDIEYNDMFNNF

SEQ ID NO: 394 - protein, 259 aa, Artificial sequence
  recombinant nanoparticle carrier subunit
MANKPMQPITSTANKIVWSDPTRLSTTFSASLLRQRVKVGIAELNNVSGQYVSVYKRPAPKPEGCADACVIMPNENQSIRCVISGSAENLATLKAEWETHKRNVDTLFASGNAGLGFLDPTAAIVSSDTTGSGEPKSDKTHTPPPAPELLGSGEPKSDKTHTPPPAPELLGSGKNLDCWVDNEEDIDVILKKSTILNLDINNDIISDISGFNSSVITYPDAQLVPGINGKAIHLVNNESSEVIVHKAMDIEYNDMFNNF

SEQ ID NO: 395 - protein, 259 aa, Artificial sequence
  recombinant nanoparticle carrier subunit
MANKPMQPITSTANKIVWSDPTRLSTTFSASLLRQRVKVGIAELNNVSGQYVCVYKRPAPKPEGCADACVIMPNENQSIRTVISGSAENLATLKAEWETCKRNVDTLFASGNAGLGFLDPTAAIVSSDTTGSGEPKSDKTHTPPPAPELLGSGEPKSDKTHTPPPAPELLGSGKNLDCWVDNEEDIDVILKKSTILNLDINNDIISDISGFNSSVITYPDAQLVPGINGKAIHLVNNESSEVIVHKAMDIEYNDMFNNF

SEQ ID NO: 396 - protein, 259 aa, Artificial sequence
  recombinant nanoparticle carrier subunit
MANKPMQPITSTANKIVWSDPTRLSTTFSASLLRQRVKVGIAELNNVSGQYVSVYKRPAPKPEGCADACVIMPNENQSICTCISGSAENLATLKAEWETHKRNVDTLFASGNAGLGFLDPTAAIVSSDTTGSGEPKSDKTHTPPPAPELLGSGEPKSDKTHTPPPAPELLGSGKNLDCWVDNEEDIDVILKKSTILNLDINNDIISDISGFNSSVITYPDAQLVPGINGKAIHLVNNESSEVIVHKAMDIEYNDMFNNF

SEQ ID NO: 397 - protein, 260 aa, Artificial sequence
  recombinant nanoparticle carrier subunit
MANKPMQPITSTANKIVWSDPTRLSTTFSASLLRQRVKVGIAELNNVSGQYVSVYKRPAPKPEGCADAGCVIMPNENQSIRTVISGSAENLATLKAEWETHKRNVDTLFASGNAGLGFLDPTAAIVSSDTTGSGEPKSDKTHTPPPAPELLGSGEPKSDKTHTPPPAPELLGSGKNLDCWVDNEEDIDVILKKSTILNLDINNDIISDISGFNSSVITYPDAQLVPGINGKAIHLVNNESSEVIVHKAMDIEYNDMFNNF

SEQ ID NO: 398 - protein, 126 aa, Artificial sequence
  protein tag
GAMVDTLSGLSSEQGQSGDMTIEEDSATHIKFSKRDIDGKELAGATMELRDSSGKTISTWISDGQVKDFYLMPGKYTFVETAAPDGYEVATAITFTVNEQGQVTVNGKATKGDAHIVMVDAYKPTK

SEQ ID NO: 399 - protein, 172 aa, Artificial sequence
  recombinant nanoparticle subunit
AHIVMVDAYKPTKGSGSAMQIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPITFGVITADTLEQAIERAGTKHGNKGWEAALSAIEMANLFKSLR

SEQ ID NO: 400 - protein, 172 aa, Artificial sequence
  recombinant nanoparticle subunit
AHIVMVDAYKPTKGSGSAMQIYEGKLTAEGLRFGIVASRFNHALVDRLVEGCIDAIVRHGGREEDITLVRVPGSWEIPVAAGELARKENISAVIAIGVLIRGATPHFDYIASEVSKGLADLSLELRKPITFGVITADTLEQAIERAGTKHGNKGWEAALSAIEMANLFKSLR

SEQ ID NO: 401 - protein, 172 aa, Artificial sequence
  recombinant nanoparticle subunit
AHIVMVDAYKPTKGSGSAMQIYEGKLTAEGLRFGIVASRFNHALVDRLVEGAIDAIVRHGGREEDITLVRVPGSWEIPVAAGELARKENISAVIAIGVLIRGATPHFDYIASEVSKGLADLSLELRKPICFGVITADTLEQAIERAGTKHGNKGWEAALCAIEMANLFKSLR

SEQ ID NO: 402 - protein, 172 aa, Artificial sequence
  recombinant nanoparticle subunit
AHIVMVDAYKPTKGSGSAMCIYEGKLTAEGLRFGIVASRFNHALVDRLVEGAIDAIVRHGGREEDICLVRVPGSWEIPVAAGELARKENISAVIAIGVLIRGATPHFDYIASEVSKGLADLSLELRKPITFGVITADTLEQAIERAGTKHGNKGWEAALSAIEMANLFKSLR

SEQ ID NO: 403 - protein, 172 aa, Artificial sequence
  recombinant nanoparticle subunit
AHIVMVDAYKPTKGSGSAMQIYEGKLTAEGLRFGIVASRFNHALVDRLVEGAIDAIVRHGGREEDITLVRVCGSWEIPVAAGELARKENISAVIAIGVLIRGATPHFDYIASEVSKGLADLSLELRKPITFGVITADTLEQAIERAGTKHGNKGWEAALCAIEMANLFKSLR

SEQ ID NO: 404 - protein, 172 aa, Artificial sequence
  recombinant nanoparticle subunit
AHIVMVDAYKPTKGSGSAMQIYEGKLTAEGLRFGIVASRFNHALVDRLVEGAIDAIVRHGGREEDITLVRVPGSWEIPVAAGELARKENISAVIAIGVLIRGATPHFDYIASCVSKGLCDLSLELRKPITFGVITADTLEQAIERAGTKHGNKGWEAALSAIEMANLFKSLR

SEQ ID NO: 405 - protein, 187 aa, Artificial sequence
  recombinant nanoparticle subunit
AHIVMVDAYKPTKGGGSGDPMLSKDIIKLLNEQVNKEMQSSNLYMSMSSWCYTHSLDGAGLFLFDHAAEEYEHAKKLIIFLNENNVPVQLTSISAPEHKFEGLTQIFQKAYEHEQNISESINNIVDHAIKSKDHATFNFLQWYVAEQHEEEVLFKDILDKIELIGNENHGLYLADQYVKGIAKSRKS

SEQ ID NO: 406 - protein, 181 aa, Artificial sequence
  recombinant nanoparticle subunit
AHIVMVDAYKPTKGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNESHGLYLADQYVKGIAKSRKS

SEQ ID NO: 407 - protein, 547 aa, Artificial sequence
  carrier protein
MKNLDCWVDNEEDIDVILKKSTILNLDINNDIISDISGFNSSVITYPDAQLVPGINGKAIHLVNNESSEVIVHKAMDIEYNDMFNNFTVSFWLRVPKVSASHLEQYGTNEYSIISSMKKHSLSIGSGWSVSLKGNNLIWTLKDSAGEVRQITFRDLPDKFNAYLANKWVFITITNDRLSSANLYINGVLMGSAEITGLGAIREDNNITLKLDRCNNNNQYVSIDKFRIFCKALNPKEIEKLYTSYLSITFLRDFWGNPLRYDTEYYLIPVASSSKDVQLKNITDYMYLTNAPSYTNGKLNIYYRRLYNGLKFIIKRYTPNNEIDSFVKSGDFIKLYVSYNNNEHIVGYPKDGNAFNNLDRILRVGYNAPGIPLYKKMEAVKLRDLKTYSVQLKLYDDKNASLGLVGTHNGQIGNDPNRDILIASNWYFNHLKDKILGCDWYFVPTDEGWTNDGSGDSATHIKFSKRDEDGKELAGATMELRDSSGKTISTWISDGQVKDFYLYPGKYTFVETAAPDGYEVATAITFTVNEQGQVTVNGKATKGDAHI

SEQ ID NO: 408 - protein, 12 aa, Artificial sequence
  protein tag
HIVMVDAYKPTK

SEQ ID NO: 409 - protein, 92 aa, Artificial sequence
  protein tag
DSATHIKFSKRDEDGKELAGATMELRDSSGKTISTWISDGQVKDFYLYPGKYTFVETAAPDGYEVATAITFTVNEQGQVTVNGKATKGDAHI

SEQ ID NO: 410 - protein, 283 aa, Artificial sequence
  recombinant nanoparticle subunit
MEFLKRSFAPLTEKQWQEIDNRAREIFKTQLYGRKFVDVEGPYGWEYAAHPLCEVEVLSDENEVVKWGLRKSLPLIELRATFTLDLWELDNLECGKPNVDLSSLEETVRKVAEFEDEVIFRGCEKSGVKGLLSFEERKIECGSTPKDLLEAIVRALSIFSKDGIEGPYTLVINTDRWINFLKEEAGHYPLEKRVEECLRGGKIITTPRIEDALVVSERGGDFKLILGQDLSIGYEDREKDAVRLFITETFTFQVVNPEALILLKFGGGSGAHIVMVDAYKPTK

It is claimed:

1. An immunogenic conjugate, comprising:
a self-assembling protein-nanoparticle carrier comprising a multimer of fusion proteins, wherein each fusion protein comprises a self-assembling protein nanoparticle subunit fused to a heterologous carrier protein, and wherein the fusion proteins self-assemble to form the self-assembling protein-nanoparticle carrier; and
HIV-1 Env fusion peptides conjugated to the self-assembling protein-nanoparticle carrier, wherein the HIV-1 Env fusion peptides comprise, from the N-terminus, the amino acid sequence of residue 512 to one of residues 514-521 of a human immunodeficiency virus type 1 (HIV-1) Envelope (Env) protein according to the HXB2 numbering system; and
wherein the immunogen elicits an immune response to HIV-1 Env.

2. A recombinant self-assembling nanoparticle subunit, comprising:
a lumazine synthase nanoparticle subunit comprising cysteine substitutions to introduce one or more non-native disulfide bonds to increase stability of the nanoparticle, wherein the cysteine substitutions comprise 121C and 131C substitutions, 121CG and 131C substitutions, 121GC and 131C substitutions, 7C and 40C substitutions, 3C and 50C substitutions, 82C and 131CG substitutions, 5C and 52C substitutions, or 95C and A101C substitutions, or a combination thereof, wherein residue numbering corresponds to a reference lumazine synthase subunit set forth as SEQ ID NO: 25;
an encapsulin nanoparticle subunit comprising cysteine substitutions to introduce one or more non-native disulfide bonds to increase stability of the nanoparticle, wherein the cysteine substitutions comprise 53C and 94C substitutions, 53C and 96C substitutions, or 146C and 185C substitutions, or a combination thereof, wherein residue numbering corresponds to a reference encapsulin subunit set forth as SEQ ID NO: 43;
an acinetobacter phage AP205 protein nanoparticle subunit comprising cysteine substitutions to introduce one or more non-native disulfide bonds to increase stability of the nanoparticle, wherein the cysteine substitutions comprise a T81C substitution, 53C and 100C substitution, or 82C and 80C substitutions, or a combination thereof, wherein residue numbering corresponds to a reference acinetobacter phage AP205 protein subunit set forth as SEQ ID NO: 316; or
a Hepatitis B capsid protein nanoparticle subunit comprising cysteine substitutions to introduce one or more non-native disulfide bonds to increase stability of the nanoparticle, wherein the cysteine substitutions comprise 25C and 127C substitutions, 14C and 36C substations, 29C and 127C substitutions, 18C and 36C substitutions, or 29C and 127C substitutions, or a combination thereof, wherein residue numbering corresponds to a reference Hepatitis B capsid protein subunit set forth as SEQ ID NO: 321.

3. A recombinant self-assembling nanoparticle subunit, comprising:
a ferritin nanoparticle subunit comprising or consisting of the amino acid sequence set forth as any one of SEQ ID NOs: 258-305;
a lumazine synthase nanoparticle subunit comprising or consisting of the amino acid sequence set forth as any one of SEQ ID NOs: 306-312;
an encapsulin nanoparticle subunit comprising or consisting of the amino acid sequence set forth as any one of SEQ ID NOs: 313-315;
a *Acinetobacter* phage AP205 protein nanoparticle subunit comprising or consisting of the amino acid sequence set forth as any one of SEQ ID NOs: 317-320; or
a Hepatitis B capsid protein nanoparticle subunit comprising or consisting of the amino acid sequence set forth as any one of SEQ ID NOs: 322-326.

4. The recombinant self-assembling nanoparticle subunit of claim 3, wherein the recombinant self-assembling nanoparticle subunit is fused to a heterologous carrier protein.

5. The recombinant self-assembling nanoparticle subunit of claim 4, wherein the heterologous carrier protein is selected from any one of a tetanus toxin heavy chain C fragment, a diphtheria toxin variant CRM197, and an *H influenzae* protein D, a Keyhole Limpet Hemocyanin (KLH) functional unit, a Meningococcal outer membrane protein complex protein, an Outer-membrane lipoprotein carrier protein, or a Cholera toxin B subunit.

6. The recombinant self-assembling nanoparticle subunit of claim 5, wherein the heterologous carrier protein is the tetanus toxin heavy chain C fragment.

7. A nucleic acid molecule encoding the recombinant self-assembling nanoparticle subunit of claim 2.

8. A recombinant self-assembling nanoparticle comprising the recombinant self-assembling nanoparticle subunit of claim 2.

9. The recombinant self-assembling nanoparticle of claim 8, conjugated to a vaccine antigen.

10. An immunogenic composition comprising the recombinant self-assembling nanoparticle of claim 9.

11. A method for generating an immune response to a vaccine antigen in a subject, comprising administering to the subject an effective amount of the immunogenic composition of claim 10 to generate the immune response.

12. A nucleic acid molecule encoding the recombinant self-assembling nanoparticle subunit of claim 3.

13. A recombinant self-assembling nanoparticle comprising the recombinant self-assembling nanoparticle subunit of claim 3.

14. The recombinant self-assembling nanoparticle of claim 3, conjugated to a vaccine antigen.

15. An immunogenic composition comprising the recombinant self-assembling nanoparticle of claim 14.

16. A method for generating an immune response to a vaccine antigen in a subject, comprising administering to the subject an effective amount of the immunogenic composition of claim 15 to generate the immune response.

* * * * *